United States Patent
Nesterov et al.

(10) Patent No.: US 10,024,845 B2
(45) Date of Patent: Jul. 17, 2018

(54) METHODS FOR DETERMINING MODULATORS OF INSECT TRANSIENT RECEPTOR POTENTIAL V (TRPV) CHANNEL

(71) Applicant: BASF SE, Ludwigshafen (DE)

(72) Inventors: Alexandre Nesterov, Chapel Hill, NC (US); Ramani Kandasamy, Chapel Hill, NC (US); Barbara Wedel, Durham, NC (US); Vincent L Salgado, Durham, NC (US)

(*) Notice: Subject to any disclaimer, the term of this patent is extended or adjusted under 35 U.S.C. 154(b) by 0 days.

(21) Appl. No.: 15/106,872

(22) PCT Filed: Dec. 19, 2014

(86) PCT No.: PCT/IB2014/003205
§ 371 (c)(1),
(2) Date: Jun. 21, 2016

(87) PCT Pub. No.: WO2015/097560
PCT Pub. Date: Jul. 2, 2015

(65) Prior Publication Data
US 2017/0003279 A1 Jan. 5, 2017

Related U.S. Application Data

(60) Provisional application No. 61/920,201, filed on Dec. 23, 2013.

(51) Int. Cl.
*G01N 33/50* (2006.01)
*G01N 33/68* (2006.01)
*C07K 14/435* (2006.01)

(52) U.S. Cl.
CPC ... *G01N 33/5041* (2013.01); *C07K 14/43581* (2013.01); *G01N 33/5085* (2013.01); *G01N 33/6872* (2013.01); *C12N 2710/10041* (2013.01); *G01N 2333/43552* (2013.01); *G01N 2333/43573* (2013.01); *G01N 2430/10* (2013.01)

(58) Field of Classification Search
None
See application file for complete search history.

(56) References Cited

U.S. PATENT DOCUMENTS

2007/0105086 A1* 5/2007 Qin ................ A61K 31/05 435/4

OTHER PUBLICATIONS

Olszewska et al in "Opposite Effect of Capsaic Capsazepine on Behavioral Thermoregulation in Insects" (Journal of Comparative Physiology; Jun. 11, 2011, pp. 1021-1026).*

Vriens et al: "Herbal Compounds and Toxins Modulating TRP Channels", (Current Neuropharmacology, vol. 6, No. 1, Mar. 1, 2008, pp. 79-96).*
Vriens "Pharmacology of Vanilloid Transient Recept Potential Cation Channels", (Molecular Pharmacology, vol. 75, No. 6, Mar. 18, 2009, pp. 1262-1279).*
Gong et al: "Two Interdependent TRPV Channel Subunit: Inactive and Nanchung, Mediate Hearing in *Drosophila*", (Journal of Neuroscience, vol. 24, No. 41, Oct. 13, 2004, pp. 9059-9066).*
Liedtke et al: Functionality of the TRPV subfamily of T ion channels: add mechano-TRP and osmo-TRP to the lexico CMLS Cellular and Molecular Life Sciences, vol. 62, No. 24, Dec. 1, 2005, pp. 2985-3001.*
Kim et al: "A TRPV family ion channel required for hearing in *Drosophila*", (Nature, vol. 424, Jul. 3, 2003, pp. 81-84).*
Iwata et al: "Dominant-negative inhibition of Ca2+ influx via TRPV2 ameliorates muscular dystrophy in animal models" (Human Molecular Genetics, vol. 18, No. 5, Mar. 1, 2009, pp. 824-834).*
Kim et al., "TRPV Family Ion Channel Required for hearing in Drosophila," Nature, vol. 424, No. 6944, pp. 81-84, 2003.
Gong et al., "Two Interdependent TRPV Channel Subunits, Inactive and Nanchung, Mediate Hearing in *Drosophila*," J. Neuroscience, vol. 24, No. 41, pp. 9059-9066, 2004.
Ausborn et al., "The Insecticide Pymetrozine Selectively Affects Chordotonal Mechanoreceptors," J. Exp Biol. vol. 208, pp. 4451-4466, 2005.
Thorneloe et al., "N-((1S)-1-{[4-((2S)-2-{[(2,4-dichlorophenyl)sulfonyl]amino}-3-hydroxypropanoyl)-1-piperazinyl]carbonyl}-3-methylbutyl)-1-benzothiophene-2-carboxamide (GSK1016790A), a novel and potent transient receptor potential vanilloid 4 channel agonist induces urinary bladder contraction and hyperactivity: Part I," J. Pharmacological Exp. Ther., vol. 326, No. 2, pp. 432-442, 2008.
Chang, G.C. and Snyder, W.E., "Pymetrozine causes a nontarget pest, the Colorado potato beetle (*Coleoptera: Chrysomelidae*), to leave potato plants," J Econ Entomol., vol. 101, No. 1, pp. 74-80, 2008.
Maienfisch, P. "Selective Feeding Blockers: Pymetrozine, Flonicamid, and Pyrifluqulnazon. Modern Crop Protection Compounds;" Wolfgang Kramer, Editor, Second Ed., chapter 33, pp. 1325-1346, 2012.
Douglas, J.T. "Adenovirus-mediated gene delivery: an overview," Methods Mol Biol., vol. 246, pp. 3-14, 2004.
International Search Report and Written Opinion for international application PCT/IB2014/003205 dated Aug. 12, 2015.
Keiichi Nagata, TRP channels as target sites for insecticides: physiology, pharmacology and toxicology, Springer, Verlag 2007, Invert Neurosci (2007) 7:31-37, Published.
Online: Feb. 7, 2007, DOI 10.1007/s10158-007-0044-4.

* cited by examiner

Primary Examiner — Catherine S Hibbert

(57) ABSTRACT

The present invention relates to a screening method for determining whether or not a candidate compound is a modulator of an insect transient receptor potential V (TRPV) channel. The present invention further provides a method of insect control by applying to an insect-specific TRPV channel modulator determined by the screening method. The present invention further relates to an expression vector that includes a nucleic acid molecule coding for an insect TRPV channel. Also, the present invention relates to cell that includes the expression vector encoding a TRPV channel.

12 Claims, 113 Drawing Sheets

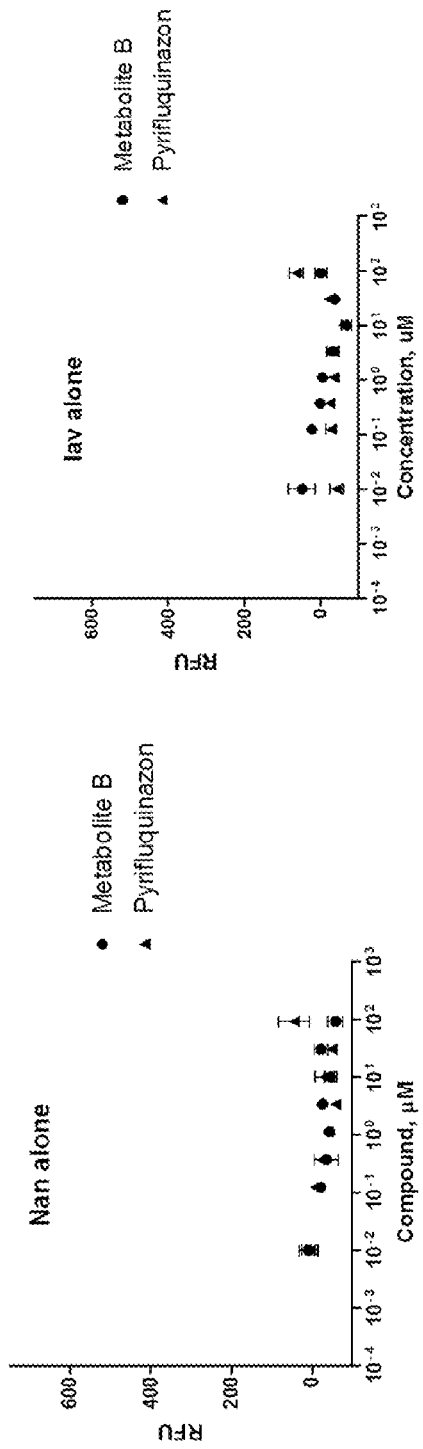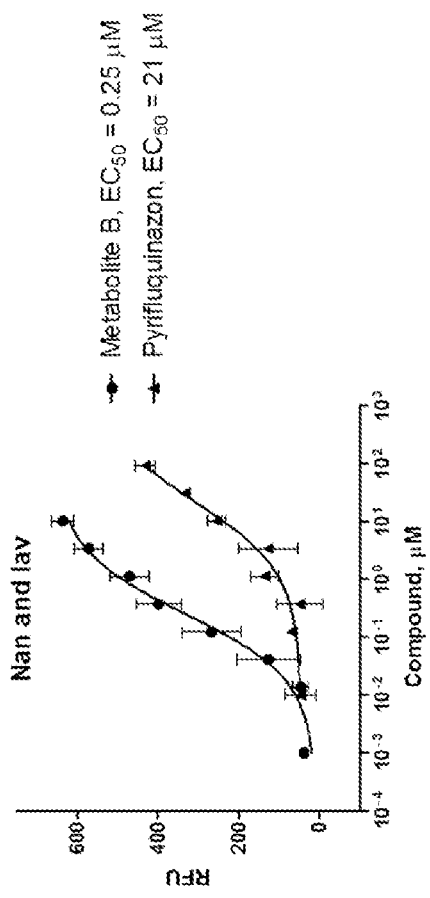

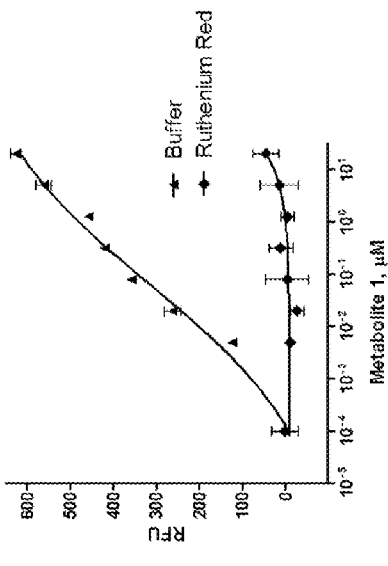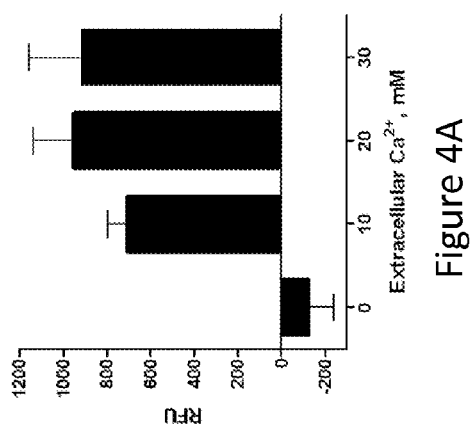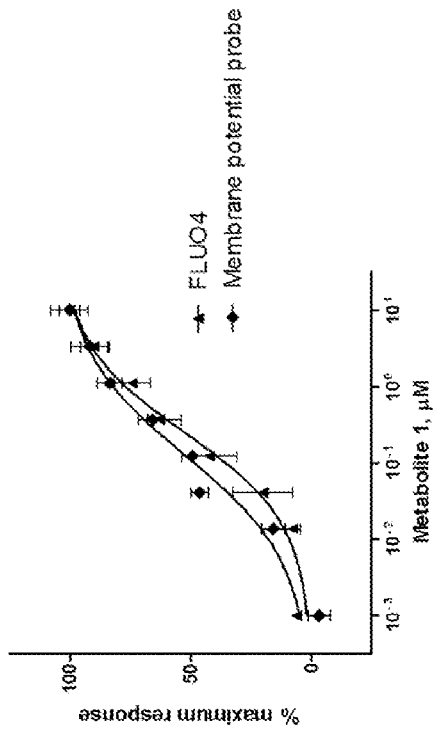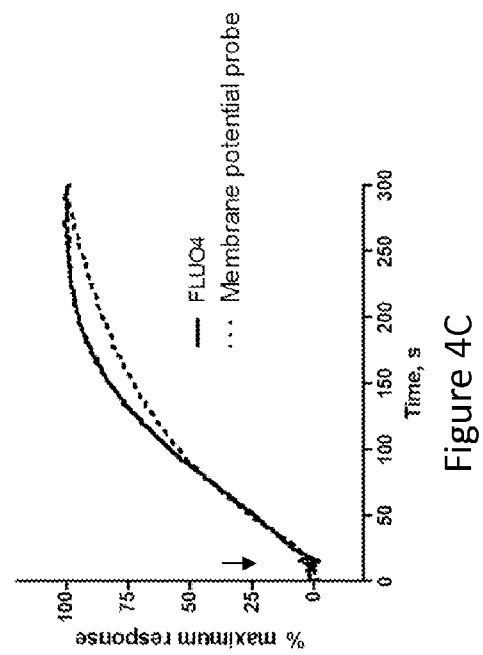
Figure 4A
Figure 4B
Figure 4C
Figure 4D Figure 6 - SEQ ID NO: 1
<> 1
<> 2502
<> DNA
<> Drosophila melanogaster
<> NM_140439.3
<> ?
>gi|386771074|ref|NM_140439.3| Drosophila melanogaster nanchung (nan),
transcript variant A, mRNA
ATGGGGAATACGGAGAGCAATGTTACCAGCGGGGTGAAGAAGCAGGCCGGAGTCTCCACCCAGGCTCTATACAAGTT
CGTGAATCTCAAGGGCGGTGGACTCCTGGTGGACATGATGAAAAGAGCCTGTCAAACCAAACAGTTTGCTGAGATCG
ATCATGCTATCAAAACCAAAGTGGAGCCCTTTCTGTACAACAAGGGCGCTGGACGGTATTTTCCCATCTCGAAGCTC
GTACTGCTGCGAAATCGGGATCGCCCACGCACTCGCCAATTGCCCGAGATCCGAGCCCTCGAGAATCCTGACGACGA
TTTCAACATCCATGACTACTGCCCCGAGGTTTCGGAGGCCGAGTATATCTCCAATCCTACGGCCTATCGATTCGTCT
GCTGGGATCTTAATATGCGTGGCGCTGTGGGCGAAACTATTCTCCATTTGTGCCTGCTAAATGCATCTTCCTTGCAC
GCAGATCTCGCCAAAAGATTGCTAAAATTCTACCCGAAACTCATCCTGGACATTTACATGAGCGACGAGTATTATGG
AGAGAGTGTCCTGCACATTGCCATCGTCAATGAAGATCCGGCAATGGTGAAGTATCTGCTGGATGCCAACGCAGATG
TTCAAGAGCGGTGCTGTGGAGCCTTCATGTCGGCGGAGGATACTAAGTTTTCTCGCACGGATTCGCCGGATCACGAG
TATGTGGCACTTTGTCCCATGACCAACTACGATGGTTATGTTTACTGGGGAGAATACCCATTGAGTTTTGCCGCTTG
CCTGTCGCAGGAGGAGTGCTTCCGCTTAGTTTTGGCCAGAGGTGCCGATCCCGACTTCCAGGACACCAACGGAAACA
CCGTTCTCCACATGCTGGTCATTTACGAAAAGATCGAAATGTTCGATGTTGGCTACGAGGTTGGAACAAACATACAC
ATAAAAAACATTCAGAATCTCACGCCCCTTACTTTGGCGGCCAAGTTGGGCAGAGTTGAGATGTTCTTCCACGTGAT
GAGCATCGAACGGGAGATCTATTGGCAATTGGGTAGCATCACATGTGCCGCATATCCGCTTTTGATGATAGACACTA
TAAATGAGGAAACCGGCAATATCAACAAGGACTCCGTGCTGAACTTTGTGGTATTTGGCGATAAGCTGGAGCACTTG
GAGCTGCTAGATGGGGGTGGTCATAGATCTGCTAAAGACCAAATGGGACACGTTCTGCAAATCGCGATTTTACAAGCA
ATTTTACATGTTCGCCCTCTACTTTCTCATCTCGCTGTTCAGTTTTATACTGCGTCCAGGTCCGGATGCCAAGGACG
AAGACGAGGATGCGCCAATAGCACTACGGCTAAAAGTGATCTGTATAGGCAAAATGGATCGGATTCTTACCATCTG
CACAGCAAGCGGGCTACAATGACTACCGAATACAAAACATTTTGGCTTAATTTTACTGAGTACTACGATCCATCGGA
AGTTGAGGTCCTGCCCGCCTGGTGGGAAAGTTATGCTCAGTGTCCTTTGATGAATCTCGAATCCGATTTGGCCAAGC
TTCGTATTATGGCAGAACTGTTGAATTTTGTAGGAGCTATCCTGTATCTGCTGGTTGCTTTGCGAGAAGCTCGATTC
CTGGGCCTTAAAATGTTTATCGAAAACTTGATGACGGCACCTTCGCGAGTTATGTTTCTGTTTTCGTGTGCTTTGAT
GATGACTATACCCTGGTTGAGGGTTTCCTGTCTCACCGAAATAGATGATCACGTCACCGTTGTGATAATGCTAACCA
CTGCTCCCTATTTTCTATTCTTTTGTCGCGGCTTCAAAACTGTCGGTCCCTTCGTAGTGATGATATACCGCATGGTC
ATGGGAGATCTGCTCCGATTCGTCTCCATCTACTTGGTGTTCGTCATGGGTTTCTCCCAGGCATTTTACATAATTTT
TCTAACCTTCGACAACCCATCGTCACCAGAGGATCAGGACGCGGAATCCAACCCAATGCCCTCGCCCATGGAATCGA
TAGTGGCCATGTTCCTAATGTCGCTAACAAATTTCGGTGACTACTATGGAGCGATGGTGTCTACGCAGCACGAATAC
GAGGCGAAGATCCTCTTCTTTCTGTTCATGGTGATCGTGAGTGTTCTGCTGGTGAACATGTTGATCGCCATGATGGG
TAATACGTATCAGAAGATCGCCGAGATCCGAAACGAGTGGCAGCGCCAATGGGCCAGGATCGTCCTCGTCGTGGAGC
GAAGTGTTCCTCCCGCCGAGCGGTTGAAGAACTTTATGCAGTACAGTCAGTCGATGTCGGATGGCAGAAGGGCACTG
GTCCTCCGGTTGAATATGACTGAGGAAAAGGAGGAGATGAAGGAGGTGCAGGAGATGAAGCGCATCCATCAACGGTT
CGCCAAGAAGCGGCAAATGGAGCGCGAGGCTCGCGCCCTTCGACGTCAACAGGAGTACGAGAAGTTCTTCGGCACCG
CCCCCAAATCGGAATGTTCCGATAACAACAACTTTTGA

```
Figure 7 - SEQ ID NO: 2

<> 2
<> 2505
<> DNA
<> Drosophila melanogaster
<> NM_001274904.1
<> ?
>gi|442632274|ref|NM_001274904.1| Drosophila melanogaster nanchung (nan),
transcript variant B, mRNA
ATGGGGAATACGGAGAGCAATGTTACCAGCGGGGTGAAGAAGCAGGCCGGAGTCTCCACCCAGGCTCTATACAAGTT
CGTGAATCTCAAGGGCGGTGGACTCCTGGTGGACATGATGAAAAGAGCCTGTCAAACCAAACAGTTTGCTGAGATCG
ATCATGCTATCAAAACCAAAGTGGAGCCCTTTCTGTACAACAAGGGCGCTGGACGGTATTTTCCCATCTCGAAGCTC
GTACTGCTGCGAAATCGGGATCGCCCACGCACTCGCCAATTGCCCGAGATCCGAGCCCTCGAGAATCCTGACGACGA
TTTCAACATCCATGACTACTGCCCCGAGGTTTCGGAGGCCGAGTATATCTCCAATCCTACGGCCTATCGATTCGTCT
GCTGGGATCTTAATATGCGTGGCGCTGTGGGCGAAACTATTCTCCATTTGTGCCTGCTAAATGCATCTTCCTTGCAC
GCAGATCTCGCCAAAAGATTGCTAAAATTCTACCCGAAACTCATCCTGGACATTTACATGAGCGACGAGTATTATGG
AGAGAGTGTCCTGCACATTGCCATCGTCAATGAAGATCCGGCAATGGTGAAGTATCTGCTGGATGCCAACGCAGATG
TTCAAGAGCGGTGCTGTGGAGCCTTCATGTCGGCGGAGGATACTAAGTTTTCTCGCACGGATTCGCCGGATCACGAG
TATGTGGCACTTTGTCCCATGACCAACTACGATGGTTATGTTTACTGGGGAGAATACCCATTGAGTTTTGCCGCTTG
CCTGTCGCAGGAGGAGTGCTTCCGCTTAGTTTTGGCCAGAGGTGCCGATCCCGACTTCCAGGACACCAACGGAAACA
CCGTTCTCCACATGCTGGTCATTTACGAAAAGATCGAAATGTTCGATGTTGGCTACGAGGTTGGAACAAACATACAC
ATAAAAAACATTCAGAATCTCACGCCCCTTACTTTGGCGGCCAAGTTGGGCAGAGTTGAGATGTTCTTCCACGTGAT
GAGCATCGAACGGGAGATCTATTGGCAATTGGGTAGCATCACATGTGCCGCATATCCGCTTTTGATGATAGACACTA
TAAATGAGGAAACCGGCAATATCAACAAGGACTCCGTGCTGAACTTTGTGGTATTTGGCGATAAGCTGGAGCACTTG
GAGCTGCTAGATGGGGTGGTCATAGATCTGCTAAAGACCAAATGGGACACGTTCTGCAAATCGCGATTTTACAAGCA
ATTTTACATGTTCGCCCTCTACTTTCTCATCTCGCTGTTCAGTTTTATACTGCGTCCAGGTCCGGATGCCAAGGACG
AAGACGAGGATGGCGCCAATAGCACTACGGCTAAAAGTGATCTGTATAGGCAAAATGGATCGGATTCTTACCATCTG
CACAGCAAGCGGGCTACAATGACTACCGAATACAAAACATTTTGGCTTAATTTTACTGAGTACTACGATCCATCGGA
AGTTGAGGTCCTGCCCGCCTGGTGGGAAAGTTATGCTCAGTGTCCTTTGATGAATCTCGAATCCGATTTGGCCAAGC
TTCGTATTATGGCAGAACTGTTGAATTTTGTAGGAGCTATCCTGTATCTGCTGGTTGCTTTGCGAGAAGCTCGATTC
CTGGGCCTTAAAATGTTTATCGAAAACTTGATGACGGCACCTTCGCGAGTTATGTTTCTGTTTTCGTGTGCTTTGAT
GATGACTATACCCTGGTTGAGGGTTTCCTGTCTCACCGAAATAGATGATCACGTCACCGTTGTGATAATGCTAACCA
CTGCTCCCTATTTTCTATTCTTTTGTCGCGGCTTCAAAACTGTCGGTCCCTTCGTAGTGATGATATACCGCATGGTC
ATGGGAGATCTGCTCCGATTCGTCTCCATCTACTTGGTGTTCGTCATGGGTTTCTCCCAGGCATTTTACATAATTTT
TCTAACCTTCGACAACCCATCGTCACCAGAGGATCAGGACGCGGAATCCAACCCAATGCCCTCGCCCATGGAATCGA
TAGTGGCCATGTTCCTAATGTCGCTAACAAATTTCGGTGACTACTATGGAGCGATGGTGTCTACGCAGCACGAATAC
GAGGCGAAGATCCTCTTCTTTCTGTTCATGGTGATCGTCGAGTGTTCTGCTGGTGAACATGTTGATCGCCATGATGGG
TAATACGTATCAGAAGATCGCCGAGATCCGAAACGAGTGGCAGCGCCAATGGGCCAGGATCGTCCTCGTCGTGGAGC
GAAGTGTTCCTCCCGCCGAGCGGTTGAAGAACTTTATGCAGTACAGTCAGTCGATGTCGGATGGCAGAAGGGCACTG
GTCCTCCGGTTGAATATGACTGAGGAGGAAAAGGAGGAGATGAAGGAGGTGCAGGAGATGAAGCGCATCCATCAACG
GTTCGCCAAGAAGCGGCAAATGGAGCGCGAGGCTCGCGCCCTTCGACGTCAACAGGAGTACGAGAAGTTCTTCGGCA
CCGCCCCCAAATCGGAATGTTCCGATAACAACAACTTTTGA
```

FIGURE 8 - SEQ ID NO: 3

```
<> 3
<> 2517
<> DNA
<> Musca domestica
<> XM_005180432
<> ?
>gi|557761541|ref|XM_005180432.1| PREDICTED: Musca domestica transient
receptor potential cation channel subfamily V member 5-like (LOC101888639),
mRNA
ATGGGAAATACTGAAAGTAATGTTACCAGTGGTGTCAAGAAACAGGCGGGAGTTTCCACCCAGGCCCTGTACAAATT
TGTCAATCTAAAGGGTGGTGGCCTTCTGGTGGACATGATGAAAAGGGCCTGTCAAACGAAACAATTCGCCGAAATAG
ATCATGCCATTAAAACCAAGGTGGAACCATTTCTCTATAACAAAGGAGCTGGTCGTTATTTTCCGATTTCGAAAATG
GTTTTGTTACGCAACAAGGAGAGGGCACGCACGAAACAACTGCCTGAAATACGGGCCCTTGAAAATCCCGATGAAGA
TTTCAATATTCACGACTACTGTTCCGAGGTGTCGGAGGCGGAGTACATATCCAATCCGAGTGCCTATCGTTTTGTTT
GTTGGAATTTGAATGAAAGAGGTGCTGTGGGTGAAACAATTCTACACTTGTGCCTGCTCAATGCCTCCTCGTTGCAT
GCGGATTTGGCCAAGAGGCTATTGAAATTTATCCCAAACTCATTATGGATATTTACTTGAGCGATGAATACTATGG
AGAATCGGTGTTACACATTGCCATTGTGAACGAGGATCCGGCAATGGTGAAATATCTATTGGATGCCAATGCCGATG
TCCAGGAGAGATGCTGTGGTGCCTTTATGTCGGCCGAAGATCAAAAGGCTTCGCGATATGACTCCCCCGAACATGAA
TATGTTGGTGTTCATCCCATGACCAATTATGATGGCTACGTTATTGGGGTGAATATCCACTGTCATTTGCAGCCTG
TTTATCGCAGGAAGAATGTTTTCGTTTGGTGTTGGCCCGTGGTGCTGATCCCGATAGCCAAGATACCAATGGCAATA
CCGTGTTGCATATGTTGGTGATCTATGAGAAAATCGACATGTTCGATGTGGCCTATGAGGTTGGCACCAATATCCAC
ATACGGAATGTACAAAATCTTACACCCCTGACATTGGCGGCCAAGTTGGCGCGGGTGGAAATGTTTTTCCACATTTT
GAGTATAGAGAGGGAAATTTACTGGCAGTTGGGTAGCATAACATGTGCCGCATATCCTTTGTCAAAAATCGATACCA
TTGATGTTAAGACTGGGAATATAAACAAGGATTCGGTGTTGAATTTTGTGGTGTTTGGGGACAAATTGGAACATTTG
GAGTTGTTGGATGGCGTGGTCATTGATTTGCTTAAAACGAAATGGGAAACATTTGTCAAGTCCCGTTTCTACAAACA
GTTTTATATGTTTTCCTTCTATTTCCTCTTCTCCTTGGTGAGTTTTATATCCCGGCCAGGACCCAAAATTGAGGATG
AAGATGAGGAGGGGGATGCGAATGATTCGGCGGGTAAAGGAAATGATTCTACCACAAATGCCAGACTTTTGTATGCC
ACACCTGCCAGTAGAGTAACAGGCATTGAAAAGTTACCCTACAAAACATTTTGGCTTAACTTTAGTGAGTACATTGA
TGATGATGCTAATGCTGAAAATATGCCCTCCTGGTGGGCAAGCTATGAGGAGTGTCCCCTGATGGATATGGAAACGA
ATTTGGCAAAGTTCCGCATTGTGTCCGAAATCGTAATTTTCTTTGGAGCGATTTTGTATTTGTTATCGGCCCTGAGA
GAGGCCAAGTTTTTGGGTTATAAAATGTTTGTTGAAAATCTGATGACGGCACCCTCAAGGGTCATGTTCTTGTTCTC
CTGCTGCCTAATGATGACCATACCCTGGCTAAGGCTATCCTGTCTCACCGAACTGGATGATCATGTGGCGGTGATGA
TAATGCTTACCACGGCTCCCTACTTTTTGTTCTTTTGTCGAGGCTTCAAGACCGTTGGTCCCTTCGTTGTGATGATC
TATCGCATGGTTATGGGAGATTTGATACGTTCGTATCGATTTATTTGGTCTTTGTGATGGGCTTTTCCCAGGCCTA
TTACATTATCTTTTTGACCTTCGATAATCCTGCCACACCGGAGGAAATTGATGATACCGGCACAAATCCCATGCCAT
CGCCCATGGAATCAGTGGTGGCCATGTTTCTAATGTCCCTGACAAATTTCGGTGATTATTACGGGGCCATGGGTTCG
ACGCAACATGAATATGAAGCGAAAATTTTATTCTTCCTTTTTATGGTGATCGTCAGTGTGTTGTTGGTTAACATGTT
GATTGCCATGATGGGTAATACGTATCAGAAGATTGCCGAGATACGCAATGAATGGCAGCGCCAATGGGCCCGCATTG
TTTTGGTTGTGGAACGTAGTGTGCCACCGGCAGAGCGTTTGAAGAATTTCATGCAGTATTCACAACCGATGTCGGAT
GGACGCAGGGCTTTGGTGTTGCGTTTAAATATGAGTGATGAGGACAAAGAGGAAATGAAAGAGGTGCAGGAAATGAA
ACGCATACATCAACGCTTTTCCAAGAAACGCCAAATGGAGCGGGAGGCCAGAGCCAAAAAGCGCCAGGAGGAATATG
AGAAATTCTTTGGCGCAACACCAACGTCCGATAATGAAAATAATAATTTCTAA
```

FIGURE 9 - SEQ ID NO: 4

```
<> 4
<> 2535
<> DNA
<> Ceratitis capitata
<> XM_004537685.1
<> ?
>gi|499014263|ref|XM_004537685.1| PREDICTED: Ceratitis capitata transient
receptor potential cation channel subfamily V member 5-like (LOC101458062),
mRNA
ATGGGGAATACCGAGAGCAATGTTACCAGCGGCGTTAAGAAACAAGCTGGCGTCTCCACGCAAGCACTCTACAAATT
CGTTAATCTCAAAGGCGGCGGCCTGCTGGTGGACATGATGAAGCGCGCTTGTCAGACAAAGCAGTTTGCAGAGATCG
ATCATGCCATTAAGACGAAGGTGGAACCTTTTCTCTACAATAAAGGCGCTGGTCGCTACTTTCCCATATCGAAGTTG
GTGCTGTTGCGTAATAAAGAGCGTGCGCGTACCAAGCAGCTGCCTGAGATTAGAGCAATGGAGAATCCCGATGAAGA
TTTTAATATACACGATCATTGTACCGAGGTTTCGGAGGCTGAGTACATATCGAATCCGAGTGCTTATCGTTATGTTT
GCTGGAATTTGAATGAACGTGGCGCTGTCGGTGAGACTATCTTGCATCTCTGTCTGTTGAATGCCTCATCGCTGCAT
GCCGATCTGGCGAAACGTCTGCTCAAGTTTTATCCCAAACTCATACTGGATGTGTATATGTGTGATGAGTATTATGG
TGAGAGCGTTTTGCATATCGCGATCGTTAACGAAGATCCAGCAATGGTTAAGTATCTGCTCGACGCAGGCGCTGATG
TGCAAGAACGCTGCTGTGGCGCCTTCATGTCCGCGGAGGATCAGAAAGCATCACGCTACGACTCACCCGATCATGAA
TATGTCGGCGTACAACCGATGACCAACTATGATGGCTACGTTTATTGGGGCGAGTATCCGATGAGTTTTGCTGCTTG
TCTCTCGCAAGAAGACTGTTTTCGTTTGGTATTGGCGCGCGGCGCTGATCCGAATCTGCAGGACACCAACGGTAATA
CCTCGCTGCATATGTTGGTGATCTATGAAAAGATCGAAATGTTCGATGTGGCCTACGAGGTGGGTACTAATATACAT
TTGCGTAATGTACAAAACCTGACAGCTTTGACGTTGGCGGCGAAATTGGGTCGCGTCGAGATGTTCTTTCACATATT
GAGTATTGAACGCGAGATCTACTGGCAGTTGGGTAGCATAACGTGTGCGGCATATCCACTCTCGATGATCGACACAA
TCGATGTGGAGACGGGTAATATCAATAAGGACTCGGTTTTGAATTTTGTCGTGTTTGGTGACAAACTGGAGCACTTG
GAGCTGCTGGATGGCGTAGTGATCGATTTGTTGAAGACCAAATGGGAGTCCTTCGTCAAGTCGCGTTTCTACAAGCA
GTTTTATATGTTCTCCTTCTATTTTCTCTTCTCATTAATCAGTTTCATCTCGCGACCAGGACCGACTGAAAAGAATG
AGGACGATGATGATGATGATGATGCTGATGCTAGCGTTGAGGCTACCGTAACGCGCGCAGCGAATAGTACGGCTCCG
CTACAACGTGGCGATCAGTGGTTCAAGCGCTTGATCAAGCGTGCTATCGACAAGATGGAATACAAAACCTTTTGGCT
GAACTTCACAGACTACTTTGATGACAACGACGTGGAATCGGTGCCACCGTGGTGGGCGAGCTATGCCGAGTGCCCGC
TTATGAACATGGAATCGGACTTAGCGAAGCTACGCATTGTGGCGGAAATAATTATATTTTTTGGCTCGGTTCTATAT
TTATTCGCCGCGCTGAGAGAGGCACGCTTTCTGGGCTATAAAATGTTTGTCGAAAATATGATGACCGCACCTTCGCG
TGTCATGTTTCTTTTCTCTTGCGCACTGATGATGTCTATACCTTGGCTGAGGGTGTTTTGTCGACTGAGATCGATG
ACCACGTGGCGGTATTTATTATGCTTACAACAGCACCCTATTTTCTGTTCTTCTGTCGCGGCTTCAAAACTGTCGGT
CCCTTCGTTGTGATGATCTATCGCATGGTCATGGGTGATCTTATACGTTTTGTCTCCATTTATTTGGTTTTTGTAAT
GGGTTTCTCGCAAGCTTACTATATTATTTTTCTCACCTTTGACAATCCCGCTACACCGGAGGAAATCGATGACTCCG
AGTCGAATCCAATGCCCTCACCAATGGAGTCTATCGTTGCAATGTTTCTGATGTCACTCACGAATTTCGGTGACTAT
TTCGGCGGCATGGCCTCGACACAGCATGAATATGAAGCGAAGACACTCTTCTTTCTCTTCATGGTAATCGTCAGTGT
GTTGTTGGTGAACATGTTGATCGCCATGATGGGTAATACCTATCAGAAGATTGCCGAAATACGCAACGAATGGCAAC
GTCAGTGGGCGCGTATAGTTTTGGTGGTGGAGCGCAGTGTACCACCAGCGGAGCGGCTCAAGAACTTCATGCACTAC
AGTCAACCAATGTCGGACGGCAGGCGTGCGTTGGTGTTGCGTTTAAATATGAGCGATGAAGTTAAGGAGGAAATGAA
GGAGGTACAAGAGACCAAACGCATACATCAGCGCTTCTCGAAGAAACGACAAATTGAGCGCGAGGCGAGAGCACAAA
AGAGACAAGAGGAGTATGAGAAATTCTTTGGCAAGAAGCCGTCGGGCAACAGTGATAACAATAATGCCTAA
```

FIGURE 10 - SEQ ID NO: 5

```
<> 5
<> 2502
<> DNA
<> Anopheles gambiae
<> XM_320300.4
<> ?
>gi|158300355|ref|XM_320300.4| Anopheles gambiae str. PEST AGAP012241-PA
(AgaP_AGAP012241) mRNA, complete cds
ATGGGAAATACCGAGAGCAATGTGACCAGTGGCGTTAAGAAGCAGGCTGGAGTGTCCACCCAGGCGCTGTACAAGTT
CGTCAACCTGAAGGGCGGCGGCCTGCTGGTGGACATGATGAAGCGCGCGATACAGAACAAGCAGTACGCCGAGATTG
ATCATGCGATCAAGACGAAGGTGGAACCGTTTCTGTACAACAAGGGCAAGGGGAAGTACATCCCCGTGTCGGTGCTG
GTGCTGTTACGAAACCGGGAGCGGCCGCGCCACAAGCAGCTGCCCGAGATCCGGGCGATGGAGAACCCGGAGGAGCA
CTTTGACATCGATGCGGTCTGTCCGGAAGTGAGCCAAGCCGAGTACTACCTAAACCCGTCCGGCTATCGGGAGGTGT
GCTGGAACATAAAGGAACGTGGCGCTGTGGGAGAGACAATTCTACACCTTTGCCTACTGAACGCCACTTCCCTGCAT
GCGGATCTAGCCAAACGACTGCTGCGCTTCTATCCCAAGCTCATCAACGACGTGTACATGTGCGACGAGTACTACGG
TGAGAATGTCCTGCATCTCGCAATCGTGAACGAAGATCCTGCCATGGTGAAGTATCTGCTCGATCACAACGCGGACG
TAAACGAGCGCTGCTGCGGTACGTTCATGTGCCCGGAAGACCAGAAAGCCTCCCGCTACGATACGCCCGAAACGGAG
GTCGTCCAGATGGTGCAGGTGACGAACTACGACGGCTACGTGTACTGGGGCGAGTACCCGCTCACCTTTGCCGCCTG
TCTCGGGCAGGAGGAGTGCTACCGGCTGGTGCTGGCCCGCGGCGCCGACCCGGACAACAAAGACTTCAACGGCAACA
CGGTGCTGCACATGCTGGTGATATACGAGAAGATTGCCACGTTCGACATGGGGTACGAGGTGGGTTCGTCGCTTAGC
ATCCGCAACCACCAGAACCTGACGCCGCTGACGCTGGCGGCCAAGCTCGGCCGGGTGGAGATGTTCTTTCACATCAT
GAACATCGAGCGCGAGATCTACTGGCAGCTGGGCAGCATCACGTGCGCGGCCTATCCGCTCGGCCTGATCGACACGA
TCGACGTGGAGACGGGAAACATTAACAAAGATTCCGCCCTCAATCTGGTGGCGTTCGGCGACAAGGACGAGCATCTC
GATCTGCTAGACGGGGTGCTGATCGATCTGCTCAAGACGAAGTGGAACACGTTCGTGAAGGACAAGTTCTATCGGCA
GTTTTTCATGTTCTTCTGCTACTTTTGCGTGTCGCTGGTGAGCTTCACGCTGCGCAATGGACCACCACCGGCGGAGG
ATGACGATGGGAAGGAGAGCGAGGCTGGGGGGAATAAAACGGCAGCTGTCACGAAGGAAGAGCTTCGTCGGCAGCTG
TGGAACGAAACGACGCTAGAGGATGCGCTGGCTGCGCTTGCCGGCAATGGAAGCTTCGCTGGACGGTTGTCGAATCT
GGAGCAGAGCAACGGAAGTAGCGACGCGATGGGTGAGTTTGATCCTGCCGAGATGGACGACGAGGGTCTGTTCTTCA
ACTCCAACTGTCACACGATGGATTACGACGGTGTGGAGGGCAAGGTGCGTCTCATATCGGAGATGATCATACTGGTC
GGTTCGTTTCTGTATCTGCTCGCTGCCTTGCGGGAGTTGAAGTTTCTTGGGCGGAAAATGTTCTTCGAAAATCTTAT
GACAGCACCATCGAGGGTTATGTTTCTGTTTTCCTGCTGCATAATGATGATCGTACCGTTTCTGAAGGTTCTCTGCT
TTACGGAGCTGGAAGATCACGTAGCCGTAACGATCATGCTGACGACGGCGCCCTATTTTTTATTCTTCGTCGTGGC
TTCAAAACGGTCGGACCGTTCGTGGTGATGATATACCGCATGGTGATGGGCGATCTGTTGCGGTTCGTCGTCATCTA
TCTGGTATTTGTGATGGGCTTCTCGCAGGCGTACTACATTGTGTTTTTGTCCTACAAACCGGACGAGGAAGGCGACC
CAAACCCGATGCCGTCGCCGATCGAGTCGATCGTAGCGATGTTTCTGATGTCGCTGACCAACTTTGGCGATTACTAT
GGCGCACTGGAGAACACCCGACCACGAGATGTGCGCAAAGATCTTGTTCGTGCTGTTCATGGTGATCGTTGCCGTGCT
GTTGGTGAACATGTTGATCGCTATGATGGGCAACACGTACCAGAAGATTGCAGAAACGAAGAACGAGTGGCAGCGCC
AGTGGGCCCGCATCGTGCTCGTCGTCGAGCGTGGCGTCCCACCCAAAGGAGCGGCTCAAGAACCTGATGTCGTACAGC
CAACCGATGTCGGACGGGCGTCGTGCGCTGGTGCTACGATTAAACATGACGGAAGATAAGGAAGAGATGAAGGAGAT
ACTCGAAATGAAGCGCGTCCACGAGCGGCTCTCTATAAAGCGGCAGATCGAGCGGGATGCACGGGCCGAGCAGCGTC
GGCTGCTGCGCGAGAAGTACTTGAATATGTCTTCATGA
```

FIGURE 11 - SEQ ID NO: 6

```
<> 6
<> 2448
<> DNA
<> Aedes aegypti
<> XM_001652374.1
<> ?
>gi|157114791|ref|XM_001652374.1| Aedes aegypti hypothetical protein partial
mRNA
ATGGGAAATACCGAGAGCAATGTCACCAGCGGAGTCAAGAAACAGGCCGGAGTGTCCACCCAGGCTCTGTACAAGTT
CGTCAATCTGAAGGGTGGTGGTCTTTTGGTGGACATGATGAAAAGAGCAATCCAAAACAAACAATATGCAGAAATAG
ATCATGCGATCAAAACGAAAGTCGAACCCTTCCTGTACAATAAGGGCAAAGGGAAGTATATCCCAGTGGCCCAGTTG
GTGCTGCTGAGGAATCGAGAACGACCTCGATCCAAGCAGTTGCCAGAGATTCGTGCCTTGGAAAACCCTGAAGAGGA
TTTCGACATTGACGCAGTATGTCCGGACGTGACCGAGGGCGAATACCAGAGGAATCCATCGGGGTACAGGGAGGTGT
GCTGGAACATCAAGGAACGAGGAGCAGTCGGCGAAACTATTCTTCATCTGTGCTTGCTGAACGCAACATCTTTGCAT
GCTGATCTTGCCAAGCGCCTACTACGTTTCTACCCGAAGCTCATCAACGATATCTACATGTGCGATGAGTATTACGG
GGAAAGTGTGCTCCACGTGGCAATTGTCAACGAAGATCCGGCCATGGTTAAGTATTTATTGGACAGTGGTTCCGATG
TAGACGAGAGATGTTGCGGAACGTTCATGTGTCCAGAGGACCAAAAGGCAACGCGATACGATTCTATCGAAACGGAA
ATCATTTGCGTACTTCCCATGACCAACTACGATGGGTATGTGTATTGGGGCGAATATCCGTTGAGTTTTGCCGCTTG
CTTAGGCCAGGAGGAATGCTACCGGTTGGTGTTGGCTCGGGGAGCTGATCCAGATAATCAGGATTCGAACGGAAACA
CCGTTTTGCACATGTTGGTCATCTACGAGAAAATCTCAACATTCGACATGGCGTATGAAGTCGGCTCATCGCTGGAC
ATAAGAAACCTGCAGAATTTGACGCCGTTGACTTTGGCAGCCAAGTTGGGTCGGGTTGAGATGTTTTTCCACATTAT
GAACATCGAACGAGAAATCTACTGGCAGTTGGGAGCTATCACTTGTGCAGCCTATCCGCTTGCTTTGATCGACACGA
TCGACATCGAAACAGGGAACATTAACAAAGATTCAGCATTAAATTTAGTGGTATTCGGCGACAAAGCGGAGCATTTA
GACCTACTAGAAGGTGTACTGATTGATTTGCTCAAGACCAAGTGGAACTCGTTCGTCAAAGACAAGTTCTATCGCCA
ATTCTTCGTGTTCTTTTGGTATTTTTGCGTTTCACTAGTAAGCTTCACTCTGAGAAGGGGACCAATGAATTTGGAGG
AGACGGCAGCCAACCGCACCACAACCAGCATTACTTTGAAAAATTTGACATTTTCTGATTCGACTAACGCAACATTA
CCCACTTTACTGGCTGCGGATGTGAACGAAAAAATCGTTCAATTTATTGCAAACGAAACGTTATTCGATCCGGCAGT
TATGGAAGAAAACACTTTCTTTAATTCTAAATGTGCCACCATGGCATACGACACACTGCAGGATAAGATAAGGTTGG
TTTCGGAGATCATCATTCTCATCGGATCATTCTTGTACCTAGTTGGAGCGTTGAGAGAATTTCGATTCTTGGGACGA
AAAATGTTCTTTGAGAATTTGATGATTTCCCCTTCTCGAGTTATGTTTCTGTTCTCGTGCTGCATAATGATGATCGT
ACCGTTTCTGAAAGTCCTTTGCTTAATCGAGCTTGAGGATCACGTTGCCGTGACGATTATGTTGACTACTGCTCCGT
ACTTTTTGTTCTTCTGTCGTGGTTTCAAAACCGTTGGACCGTTCGTTGTGATGATCTACCGCATGGTGATGGGAGAC
TTGCTGCGATTCGTCGTCATCTATCTGGTGTTCGTGATGGGATTTTCCCAGGCCTACTACATTGTGTTCTTGTCGTT
CAAGGGTGAAGAGGAAGGCGATGAAAACCCGATGCCTTCGCCGATGGAGTCGATAGTGGCGATGTTTTTGATGTCGC
TGACGAATTTCGGCGACTACTACGGTGCACTGGAGAAAACCGAGCACGAGGGATGCGCTAAGGTTCTTTTCGTCATT
TTCATGGTTATTGTGGCCGTCCTGTTGGTCAACTTGCTCATCGCCATGATGGGTAACACCTACACCATGATTGCCGA
AACGAAGAACGAATGGCAACGGCAATGGGCACGAATCGTTCTGGTAGTGGAACGAGGAGTTCCTCCGAGCGAGCGAC
TCAAAAACTTCATGAGCTACAGCCAACCCATGTCGGACGGGAGACGAGCCCTCGTGTTGCGATTGCATATGACGGAC
GAAGACAAGGAAGAGATGAAGGAAATCCTCGAGATGAAACGTGTCCATGAACGCTTGAAGAAGAAACGTCAGGTGGA
ACGAGAATTAAGAGCCGAGCAGCGACGACTAATCATGGAGAAATATGCAAACGTACCTTGA
```

FIGURE 12 - SEQ ID NO: 7

```
<> 7
<> 2451
<> DNA
<> Culex quinquefasciatus
<> XM_001847084
<> ?
>gi|170038598|ref|XM_001847084.1| Culex quinquefasciatus TRP channel protein
nanchung, mRNA
ATGGGAAATACCGAAAGTAACGTCACCAGTGGCGTCAAGAAGCAGGCCGGAGTGTCCACCCAGGCACTGTACAAGTT
TGTCAACCTGAAAGGTGGCGGCCTGCTGGTGGACATGATGAAGCGGGCGATCCAAAACAAACAGTACGCCGAAATAG
ACCACGCAATAAAGACCAAGGTGGAACCGTTTCTGTACAACAAGGGCAAGGGGAAGTACATTCCGGTGGCACAGTTG
GTGTACCTAAGGAACCGGGAACGGCCACGCCACAAGCAACTGCCGGAAATTCGTGCCCTCGAAAATCCCGAGGAGGA
CTACGATATAGACAAAGAGTGCCCGGATGTGACCGAGGGCGAGTACATGCGGAACCCCGGGGGGTACAGGGAGGTGT
GCTGGAACATCAAGGAACGTGGCGCAGTAGGCGAGACCATTTTGCATTTGTGCCTTCTGAACGCAACTTCACTGCAC
GCAGATCTGGCGAAGCGCCTGCTGCGATTCTACCCTAAACTGATTAACGATGTGTACATGTGCGATGAGTACTACGG
CGAAAGTGTGCTGCATTTGGCGATCGTCAACGAAGATCCGGCCATGGTGAAATACCTGCTGGATGCCGGGTCCGACG
TGAATGAACGGTGCTGCGGGACGTTCATGTGTCCGGAGGATCAAAAGCATCCCGGTTCGATTCACTGGAAACGGAA
ATAATCTGTGTGATGCCACAAACCAACTACGACGGATACGTCTATTGGGGAGAGTACCCGTTGAGCTTCGCCGCTTG
TTTGGGCCAGGAAGAGTGCTACCGGTTGGTGTTGGCACGGGAGCCGACCCGGATAACCAGGATTCAAACATGAACA
ACGTTCTACACATGATGGTGATTTACGAAAAGTTAACGACGTTCGACATGGCGTACGAAGTGGGTTCTTCGCTGAGC
ATAAGAAATCTCCAAAATCTAACACCGTTGACGTTGGCCGCCAAGCTGGGTCGCGTCGAAATGTTCTTCCACATCAT
GAACATTGAGCGGGAGATCTACTGGCAATTGGGAAGTATTACGTGTGCCGCCTACCCGCTGGCATTGCTCGATACCA
TCGACATCGAAACCGGCAACATTAGCAAAGATTCCGCGCTGAATCTGGTCGTTTTCGGCGACAAAGACGAGCATTTA
GATCTCCTCGAAGGAGTCCTCATCGATCTCCTGAAAACCAAATGGAACACGTTCGTCAAGGACAAGTTCTACAGCCA
ATTTTTCGTGTTCTTTTGCTATTTTTGTGTGTCACTGATTAGCTTCACACTGCGCGAGGGACCAATGAAGCTAGAGG
ACGGAGAGGCCAACAAAACTACCACGAGTATTCAGCTAAAAAATATGACCCTGGCCGACCTCACCAACGCCAGTACG
CTGTCCTCGCTACTGGTCACCGACGTGAGCGGCAAGATCGTCGGACTCAACGGGAGTGAAACGTTCTTCGACCCGTC
GACGATCGAGTCCGACATGTTCTTCAACTCCAAGTGTCCAACGATGATCTACAAGGGTATCGAGGGGAAAATTCGAC
TGGTTTCGGAAGCAATTATTCTGGTGGGATCATTTCTCTATCTGGTTTCGGCTTTGAGAGAATCTCGCTTTCTTGGG
AGGAAAATGTTTATCGAAAATTTGATGACCGCTCCTTCCAGAGTAATGTTCCTGTTTTCCTGCTGTATCATGATGGT
AGTTCCTTGCCTCAAAGTGCTATGTTTCACCGAGTTGGAAGATCACGTTGCGGTCGTGATTATGCTGACAACTGCGC
CCTACTTCCTGTTCTTCTGTCGCGGCTTCAAAACGGTCGGACCGTTCGTGGTGATGATTTACCGCATGGTGATGGGA
GATCTGCTCCGGTTCGTGGCCATTTACTCGGTGTTCGTGATGGGCTTCTCCCAGGCCTACTACATCGCGTTCCTGTC
GTACAAGGGCGAGGAGGAGGGCGACGAGAATCCGATGCCCTCGCCGATGGAGTCGATCGTGGCCATGTTTCTGATGT
CGTTGACCAACTTTGGCGATTACTACGCCGCGCTCGAGGATACCGCCCACGAGGGTTGCGCAAAGGTACTCTTTGTG
ACATACATGGTAATTGTGGCGGTGCTGTTGGTCAACTTGCTGATCGCTATGATGGGTAATACGTACACCAAGATTGC
CGAGACGAAAAACGAGTGGCAACGGCAGTGGGCTCGCATCGTTCTGGTCGTCGAGCGAGGCGTTCCACCGGCAGAAC
GTCTGAAGAACCTAATGAACTACAGTCAACCCATGTCGGACGGTAGAAGGGCCTTGGTTTTGCGATTGAATATGACG
GAAGAGGATAAGGAAGAGATGAAGGAGATCCTTGACATGAAACGGGTGCACGAACGGCTGTCCAAGAAGCGAGCAGT
TGAGCGGGAAGCACGCGCCGAGCAGAGACGTCTCATTGCGGAGAAATACGCAAACGTACCGTAG
```

FIGURE 13 - SEQ ID NO: 8

<> 8
<> 2385
<> DNA
<> Tribolium castaneum
<> XM_962803.1
<> ?
>gi|91081968|ref|XM_962803.1| PREDICTED: Tribolium castaneum similar to
nanchung CG5842-PA (LOC656262), mRNA
ATGGGTAATACCGAAAGTAACGTTACTAGTGGTGTTAAGAAGCAAGCTGGTGCTTCAGTGCAACCAATTTATAAATT
ATGCGATTTGAAAGGGGGAGGGCTCCTAGTGGAATTAATGAAACGGGCCACACAAAACAAGCAATATGCAGAACTAG
ACCACGCAATAAAAACCAAGGTGGAGCACTTTTTGTACAATAAAGGGGCTGGACGGTATTTCACAATATCGGACTTG
GTTCTTTTGAGGAATAAGGAAAGGTCTCGCCAGAAATGGTTACCACAATTGAAAGCAATGGAAAACCCTGAAGATTT
TGAAATTGATGATGAAGGCCCCGAAATAACAGAAGAACAGTATCAAAAAAATCCGCATTTGTACCGTCACGTTTGCT
GGAAAATCAAGGAACGCGGAGCCGTGGGCGAAAGCATAATGCACTTGTGTTTGCTAAATGCCACTTCCTTGCACGCT
GATATCGCAAAGAGGCTTTTACGCTTTTACCCCAAATTGATTAACGATATTTACATGTCGGATGAATATTACGGAGA
AAACGTTTTGCACATTGCTATCGTAAACGAGGATCCGTCAATGGTAAAATTCCTTCTAGATTCGGGTGTAAATATCC
AAGAACGCTGCTGTGGCAACTTTATGTGTCCCGAAGATCAGAAATCGTCTCGTTATGACTCCTTGGACCACGAGTGG
GTCAACGTTTGCCCGGTCACGAATTACGAAGGCTATGTATACTGGGGCGAATATCCTCTAACTTTCGCCGCGTGTTT
AGGACAGGAAGAGAGCTTTCGCTTGATGCTGTCCAGGGGGGCTGATCCCGATGCTCAAGACACCAACGGGAACACGG
TCCTACACTTGCTTGTCATTTTGCAGAAATTGGAGGCTTTCGATATGGCCTACGAAGTGGGGGCCAAATTATCAATC
CGAAACGTGTTGAGTCTGACTCCACTAACTCTGGCCGCAAAACTTGCCAGAATCGATATGTTTTTCCACATTTTGAA
CTTGGAACGCGAAATTTATTGGCAAATTGGCAGCATCACGTGCGCTGCTTACCCTCTATCGCAGATTGATACAATTG
ACATTGAAACGGGCCAAATAAGCAAAACTTCAGCCCTTAATCTTGTGGTGTTTGGTGACAAAGACGAGCACTTGGAG
TTGATGGACGGTGTTTTGATCGACTTGCTTAATGCGAAATGGAACACTTTTGTCAAGTTTAAATTCTACAAACAGTT
TTTCACGTTTGCGTTCTATTTTTTGATCTCCCTTGTTGCTTTCACGCTACGGCCAGGGCCCCCACACAAGGAGGCCA
AACTGGTGAATGTCACAATAAACGCCACTGTTTCAAATACTTCCAAGTGGGAAAATCTCACTTCTATACCGTTCGGT
AAAACCCCGGATGATGATGACAGCGACATGGAAGAATGGTGGGACAATTTGCAAGAAGAATGTCGCTTGATGCAACT
AGAATCACCCGAATCTAAAATTCGACTCACTGCAGAGGTTTTGATGGTTGTGGGGCTTTTGCATATCTGGCAGCCG
CAGTTCGCGAGGCTAGGTTTTTAGGGGGGCGCATGTTTTCGAAAATCTTATGACTGCACCGTCAAGAGTCATGTTT
TTATTTTCTTGTATTTTAATGTTAACGGTGCCATGTTTGAGACTGGCTTGTTGGATGAGTTTGAAGATATTGTAGC
TGTGGTGATTATGTTGACCACTGCACCGTATTTTCTCTTCTTCGTCGAGGTTTTAAAACAGTGGGACCCTTCGTTG
TGATGATCTACAGGATGGTGATGGGTGATTTGATAAGATTTGCTTCAATTTATCTAGTGTTTGTCATGGGGTTTTCT
CAAGCTTTTTACATCATTTTTCTCTCGTTTGATAACCCACTAACCCCTGACGACGTTGACGATTCCGCAACTAACCC
CATCTCCACCCCCATCGAGTCAATTATGGCGATGTTTCTGATGTCAATGACCAATTTCGGTGACTATTATGCGGCCT
TCGAAAAAACTGACCATGAATACGAAGCTAAAATGTTGTTTGTTGTATTTATGGTAATCGTTTCAATTTTACTGATC
AACATGTTGATTGCCATGATGGGCAACACTTACCAAAAAATCGCAGAGACAAGAAACGAGTGGCAAAGACAATGGGC
GCGAATTGTTTTGGTTGTTGAAAGGGGGTGAGTCCCTCTGAGCGTTTGAAACAACTTATGGTTTATTCACAACCTA
TGTCCGATGGAAGAAGGGCTTTAGTGTTGAGATTAAACCAGTCTGACGAGGACAAGGAGGAAATGAAGGAAATTCTA
GAAATGCGGCGCAGGCATGAAAGACACATAAAGAAAAGAAGCGAAAAGTTGAAAGAGAATGCAAAAAAGAATTGA

FIGURE 14 - SEQ ID NO: 9

<> 9
<> 2526
<> DNA
<> Bombyx mori
<> XM_004923013.1
<> ?
>gi|512892990|ref|XM_004923013.1| PREDICTED: Bombyx mori transient receptor
potential cation channel subfamily V member 5-like (LOC101740263), mRNA
ATGGGTAACACAGAGAGTAATGTGACGAGCGGTGTGAAGAAGCAAGCTGGGACGTCAGAGCAAAAGCTTTACAAACT
AGTCGATATAAAAGGAGGAGGTCTCCTGGTGGACATGATGAAGCGAGCTCTGCAGAACAAGCAATACGCCGAGATAG
ATCACGCTATCAAGACTAAAGTTGAGCCGTTTTTGTATAATAGAGGGAGGGGTCGATATATACCGATATCCCATCTC
GTCTTGCTCAGGAACAAAGAGAGACCGAGACACAAACTGCTGCCTCCACTCAGAGGCATGGAAAACCCTGACGAGGA
ATTTGACGTGGATAAGGACTGGCCAGTTGTTACTCAAGAGGAATATGACGCTAATCCCTCCGGATCAGGGAACTTT
GTTGGGATGTCAAAGAGAGAGGTGCAGTGGGTGAGACTATTCTGCACTTGTGTCTGCTCAATGCGACTTCGCTCCTA
GCTCATCTCGCTAAAAGACTACTACGCTTTTATCCTAAAATGATTAATGATATTTATATCAGCGATGAATACTATGG
TGAAACTGTATTACATATTACAATAGTCAACGAAGATCCGACAATGGCAAAGTTTCTACTGGACGCGGGTGCGGATT
ACCACGAGCGTTGCTACGGGAACTTCATGTGTCCTGAGGATCAAAAGGCTTCCAGGACGGACTCTTTCGATCACGAA
TGGGTCAACGTCCAGCCTGACACTAATTATAATGGGTACGTCTACTGGGGCGAGTACCCGTTGAGTTTCGCAGCATG
CTTAGGCCAGGAGGAGTGCTACCGTTTGATCTTAGCACGAGGAGCGGATCCTGATAAGCAGGATACTAATGGCAATA
CAGTTCTGCACATGCTAGTCATATACGAGAAGATGAGCACATTCGATATGGCTTACGAAGTGGGCGCGTCCCTAAAC
ATTCGTAACGTACAAAACCTAACTCCCCTAACCCTTGCCGCCAAGCTAGCTCGCACCGAGATGTTCTTTCACATTCT
AAACATCGAAAGGGAGATTTACTGGCAGATCGGCGCCACCACATGCGCCGCCTACCCTTTAGGACAAGTTGATACAA
TAGACACTGAAACAGGACTAATTAGTAAGGATTCAGCTCTGAATTTGGTTGTTTTTGGGGAAAAAGATGAGCATTTA
GGTCTACTAGAAGGTATGCTGATAGACTTATTGAAAACGAAATGGAACACGTTCGTTAAGTTTCGTTTCTACAGGCA
GTTCATATTATTTTCATGTTACTTCTTGGTTTCACTGATCTGCTTCACATTGAGACCAGGACCACCGGACAGAGCAT
TGAATACAACTGTCTTGAACTCAACTATTGGTCCAAACGTTACCGACGCCGAGCTGGTATCGGATGTCGAAATTGC
ACAATGACCCCGAACGCAGATTTTGATACGAATGCTGTTGAAGTCCTGAACGGTACTAAGTTCGGCGGTTCTCATTG
TGCACGATTCAAAAGTCACCCCAAAGAAAAATCGACTGAAGCACCCAGGGAGAATGACGTTGAAGGTTGGTGGGAAG
ACTTGACAGAGGAATGCAGGTTGATGAACTTGGACACGTGGCAAGCCAAACTAAGGATATCTGCAGAGCTTCTGTTG
TGGATGGGGCTTTGGCTTATTTCGGAGCTGCGTTACGTGAAGCAAAGTTCCTCGGCATCAAAATGTTTATAGAGAA
TCTGAGCACTGTGCCATCCAGGGTGATGTTCTTGTTTTCGTGTCTGCTGATGTTGATACTGCCAACTTTGAGGTTAT
GGTGCGCTGACGAGGCGGAGGACCATCTCGCTGTCATGATCATGCTCACTACTGCTCCTTACTTCTTGTTCTTTTGC
AGGGGTTTCAAAACAGTGGGTCCATTCGTGGTCATGATATACCGCATGGTGATGGGTGACCTGCTACGTTTCGTTTG
TATATATTTGGTATTCGTTATGGGATTCTCACAAGCGTACTACGTTATATTCTTATCATTCGACAATCCCAACACGC
CTGAAGGCGTTGATGACTCGGTGTCCAACCCAATGCCCTCCCCCATGGAGAGCATCATGGCGATGTTCCTAATGTCT
CTAACGTCGTTCTCAGATTACTATACCGCGTTCGATCGCACCGACCACGAAATAGAGGCAAAGCTCCTCTTCGTGAT
ATATATGATAATAGTAGCGATTCTCCTGGTGAACATGTTGATTGCCATGATGGGAACACTTACCAGAAGATACCGG
AGACGAGGAACGAATGGCAGCGGCAGTGGGCCCGGATAGTGCTGGTGGTGGAGCGAGGAGTTCCACCGGCGCAGAGA
TTAAAGCAGCTGATGAGCGTACAGTCAGCCTATGCCAATGGAAAGAGAGCTTTAGTCTTGAGAATCAATCAAAAGGA
CGAAGACAAGGAAGAGATGAAAGAGATTTTGGAAATGAAGAGAACTCACGAGCGCATTGTAGCTAAGAGGAAGCAAC
GGGAGGCGCTTAAGCCTGGCGAGATCCCGCCACCCGCCAGAGATTATCCTATTAGGAAATGA

FIGURE 15 - SEQ ID NO: 10

<> 10
<> 2379
<> DNA
<> Anopheles darlingi
<> gi|312376269
<> ?
>(gi|312376269:23843-24241, 24691-25751, 25787-26047, 26365-26638, 26714-
26956, 27039-27179) Anopheles darlingi Cont15134, whole genome shotgun
sequence
ATGGGAAATACGGAGAGTAATGTGACCAGTGGCGTGAAGAAGCAGGCCGGAGTGTCCACCCAGGCCCTGTACAAGTT
CGTCAACCTGAAGGGCGGTGGGCTGCTGGTGGATATGATGAAACGGGCGATCCAGAACAAGCAGTACGCCGAGATTG
ACCACGCGATCAAGACGAAGGTCGAACCCTTCCTGTACAACAAAGGCAAAGGAAAGTACATCCCGGTGTCGGTGCTG
GTGCTGTTGCGAAACAGTGAGCGACCGAGGCACAAGCAGCTGCCCGAAATCCGAGCGTTGGAGAACCCGGAGGAGGA
CTTTGATATCGATGCAGTCTGCCCGGAAGTGAGCGAAGCGGAGTACTACCTCAACCCATCCGGGTACCGGGAGGTGT
GCTGGAACGTCAAGGAACGTGGAGCAGTCGGTGAGACGATTCTGCATCTTTGCCTGCTCAACGCTACGTCACTACAT
GCCGATCTGGCGAAGCGGCTTCTACGCTTCTATCCAAAGCTCATCAACGACGTGTACATGTGCGACGAGTACTACGG
CGAGAGTGTTCTCCATCTGGCCATCGTAAACGAGGATCCCGCGATGGTGAAATACCTGCTCGATCACAACTCGGACG
TAAACGAGCGCTGCTGCGGGACGTTCATGTGCCCGGAGGATCAAAAGGCTTCCCGCTACGATACTCCCGAGACGGAA
GTCGTCCAGATGGTGCAGCTCACGAACTACGATGGGTACGTGTATTGGGGCGAGTATCCCCTTACATTTGCCGCCTG
TCTAGGACAAGAAGAGTGCTACCGGCTGGTGTTGGCCCGCGGTGCCGACCCGGACAACAAGGACTTTAACGGCAACA
CGGTACTGCATATGCTGGTGATATACGAGAAGATTACCACGTTCGATATGGGCTACGAGGTAGGATCATCGTTAAGC
ATACGGAATCACCAGAATCTAACGCCGCTAACGTTGGCGGCGAAGCTTGGCCGCGTCGAGATGTTCTTCCACATTAT
GAACATTGAGCGAGAGATTTACTGGCAGCTGGGTAGCATTACCTGTGCCGCCTATCCGCTCGTCCTGATCGACACGA
TCGACGTAGAAACCGGTAACATCAGCAAAGACTCGGCCCTGAATTTGGTCGTGTTTGGTGACAAAGATGAGCATCTG
GATCTACTGGACGGTGTGCTGATCGATCTGCTCAAGACGAAGTGGAACACGTTCGTGAAGGACAAATTCTATCGACA
GTTCTTCATGTTTTTCTGCTACTTCTGTGTTTCGCTGATCGGCTTCACGCTACGCAATGGACCACCACCGCCCGAGG
AAGACGACGAAAATCGTGCCGGTGGTGGCAGTGGCAACAAAACGTCCTCAGCTTCGAAGCAGGATCTTCGGCAACGA
TTATGGAACCGAACGGTAACATTAGAGGACGCGGACAATGTAAGCAGCCTTTTAAGTGACATTATGGGGATTGATGC
GCTTGGCAAACTGGCCGAGCAGCTTCTTAACGGAAGCGAAGGATCGGGTGCATTCAAACCCGAAACGGTCGAAGAGG
AAGAGGATGGGCTGTTCTTCAACTCCAAGTGTCACACCATGGATTATGATGGCGTTGAGGGAAAGGTACGATTCGTG
GCCGAAGTCATCATACTGATCGGTTCCTTCCTCTATCTCCTGTCGGCGTTGCGCGAGCTAAAGTTTCTTGGCCGGAA
GATGTTCTTCGAAAATTTGGTAAGCCGTGGCTTCAAGACGGTCGGTCCTTTCGTGGTGATGATCTACCGTATGGTGA
TGGGTGATCTGCTGCGGTTCGTCGTCATCTATCTGGTGTTTGTGATGGGTTTCTCGCAGGCGTACTATATCGTGTTT
CTCTCCTACAAACCGGAGGAGGACGGTGACGCCAATCCGATGCCATCGCCCATCGAATCGATCGTCGCCATGTTTCT
GATGTCGCTGACCAACTTTGGGGATTACTATGGAGCGCTCGAAAACACGGATCACGAGATGTGCGCCAAGATCCTGT
TCGTGCTCTTTATGGTGATTGTGGCGGTGCTGTTGGTGAACATGCTGATCGCTATGATGGGTAACACCTACCAGAAG
ATCGCCGAAACCAAGAACGAATGGCAACGCCAGTGGGCACGCATCGTGCTGGTGGTAGAACGTGGTGTGCCACCGAA
GGAGCGGCTCAAAAATCTCATGTCCTACAGTCAACCGATGTCGGATGGTCGGCGAGCACTGGTGCTCCGGTTAAACA
TGACGGACGAAGACAAAGAGGAAATGAAGGAGATCCTCGAGATGAAACGTGTTCACGAGCGGCTGTCGAAGAAGCGG
CAGGTCGAGCGGGATGCCCGGGCCGAGCAGCGACGTTTGCTCGCGCGAAAAATATCTCAACATGACGTAG

FIGURE 16 - SEQ ID NO: 11

```
<> 11
<> 2703
<> DNA
<> Acyrthosiphon pisum
<> XM_001947872.2
<> ?
>gi|328706725|ref|XM_001947872.2| PREDICTED: Acyrthosiphon pisum transient
receptor potential cation channel subfamily V member 6-like (LOC100160148),
mRNA
ATGGGTAACACCGAGAGCAATGTGGCCAGTGGTGTCAAGAAGCAAGTCGACACCTCGTCACTGCAGATATACAACCT
TGTCGACCTGAAAGGTTGTGGTCTTCTCGTGGATTTGATGAAGAAAGCCGTGCAGACGAAAAATTTTACCGAGCTGG
ACAACGCGATCAAAACCCAAGTGGAACCCATGCTGTACAACAAAGGTGAAGGTAGAATGATACCTATCGCCAAACTC
GTGTTGCTGAGAAATCGCGACCGTTCCCGGGCAAGATGGCTTCCACCGCTAAAGAACATGGAAGACACCAATGATTA
CGACATAGAAAAGACATTCCCACCATTGAAGAACTGGAAAAGCTGGGGAAGTGCAGTACAGGGAAGTGTGCTGGG
ATCTGAAGGAAAGAGGCACCGTCGGCGAAACGGCGTTACATCTATGTTTGCTGAACGCTACGTCAATACACGCAGAC
TTGGCCAAAAGGCTGTTGCATTTCTATCCAAAGCTCGTAAATGACATTTACATGATTGACGAGTATTACGGAGAGAG
CGTTTTGCACATGGCCATCGTCAACGAAGATCCGGCCATGGTGAAGGTACTGATGGACAGCGGGGCTAACCTCAACG
AACGGTGTTTCGGGAACTTCATGAGCACTGAAGATCAAAAGGCTTCTAGATCGGATTCGCTCGACCACGAATGGGTG
AACCTATGTCCCGACACCAATTATGAAGGGTACGTGTATTGGGGCGAATATCCACTGTCATTTGCAGCGTGTCTCGG
CCAAGAGGAGAGCTACCGTTTGATGTTGGCGAGAGGCGCTGACCCAAATAACCAGGACACCAACGGCAACACGGTTC
TGCATATGCTTGTAATTTACGAAAAAATTTCGACGTTCGACATGGCCTACGAAATTGGGGCGGAACTCAACATTAGG
AACGTGCAAAATTTGACGCCACTCACACTGGCCGCGAAACTGGCTCGGATCCAAATGTTCTTTCACATACTCAAAT
CGAACGGGAAATTTATTGGCAAATCGGCAGTATCACTTGTGCTGCGTACCCCCTGACCCAAATCGACACCATCGACA
ATGACACCGGGCAGATCAGCAGAAACTCGGCGCTCAACTTGGTTGTATTTGGCGAAAGTCCGGAACACTTGGAGATG
ATGGACGGTGTGTTGGTGGATCTGTTAAATGCCAAATGGAACGCTTTCGTGAAATTCCGGTTCTATAGGCAGTTCAT
CTTGTTCGCCTTTTACTTTTCCATATCTATGGTATGCTTCGTGCTGCGTCCCGGACCGCCACCCACTGGTCTTAAGC
CACCATTAATCAACTACACTTCCACGTCGACCACGGTGGCCACCACGCCGTTTGACTTCATGGACAACGAGTCGATG
TTGCCCGACATGTACGACGAGATGATGATCGGCGGTGGCGGTCCGACCGAGTTCGAGACGGTGCAGGTGACCACGGA
AATGGCGACGACCAGCGACAACGCGACGACGACCAACAACGGTAGCGGTATCGGAACGCCACTGATCTACGAGGACG
GCGGCGGTGGAGGTGGTGGAGGTGGTACCGTGAGCTTGCACGGGAAGAGTTCGGGTTCGGACAGGGGCAAACACAGG
AGCACGTGGAGTCCGGCCAACCATACGTTCAAGACCAACTACACGTACAACTACAACAAATCAAGAAAATTTTGGTG
GAACAAGAGACAAAAGGTATGCAGATTAATGGCTGTGCACTCGACTGACGATTTAATCAGAATGGGATCGGAAGTGG
GAATGTTTATGGGAGCATTCCTCTATCTTCTGGCCGCGGTCAGAGAAGCTGGTTTTTTGGGCACACAGATGTTCATT
GAAAACTTGGCCATAGCACCGGCAAGAGTGATGTTTCTGTTCTCGTGCCTGCTCATGATGACCATACCGCCGCTGAG
ACTGACATGCTATGACAAAGCCGAAGACATAATAGCCGTAATCATTATGTTGACCACTTGTCCGTACTTTTTGTTCT
TCTGCAGGGGTTTCAAAACCGTCGGGCCATTCGTGGTGATGATCTATAGGATGGTGATGGGAGACTTGTTGAGGTTC
GTTTCCATTTACATGGTGTTCGTGATGGGTTTCTCGCAAGCTTATTACGTGATTTTCCTGTCTTACGACAATCCGCT
GACGCCAGAGGGTATCGATGACTCGGTACTGAACCCGATGCCCACGCCGACCGAGTTCCATCATGGCGATGTTCCTTA
TGTCCGTCAACACGTTCACAGACTACTACACGGCGTTTGACAAGACTAGTCACACGTTGGTCGCAAAGTTTTGCTTT
ATAGTTTTCATGGTAATCGTGGCCATATTGCTGGTGAACATGTTGATCGCCATGATGGGCAACACTTATCAAAAGAT
TGCCGAGACCAGAAACGAATGGCAGAGACAATGGGCTCGGATCGTACTGGTGGTAGAGAGAGGTGTCAGTCCGTCGC
AAAGGCTCATAAAGCTCATGTACTACTCGCAACCGATGTCAGATGGCCGGAGGGCGTTGGTGTTGCGACTCAATCAG
ACGGATGAAGACAAGGAGCAAATGAAAGAGATATTGGAAATGAAACGCATTCACAATCGCTATGTAGAAAGAATGCG
CGCCAGAGACCTGAGCAGCAAACTATCGTCTTCGTGCGGAAAAAATGCAAACAATGGGACATTTAATCTAAAAGCAA
ATGAATAA
```

FIGURE 17 - SEQ ID NO: 12

```
<> 12
<> 2124
<> DNA
<> Dendroctonus ponderosae
<> gi|459669722
<> ?
>(gi|459669722:185092-185182, 185261-185343, 185427-185522, 185961-186048,
186740-186916, 186972-187161, 188137-188290, 188952-189102, 190036-190139,
190195-190330, 190603-190754, 192662-192816, 192876-192985, 193039-193220,
193273-193527) Dendroctonus ponderosae unplaced genomic scaffold Seq_983944,
whole genome shotgun sequence
ATGGGTAATACCGAGAGTAATGTTACTAGTGGCGTCAAAAAACAGGCGGGAGCCGCCATGCAGCCGATATATAAACT
TTGTGATTTGAAAGGGGCGGTCTGCTGGTGGAACTTATGAAAAGGGCAGCCCAGAATAAGCAGTACGCGGAAATAG
ATCACGCCATCAAAACTAAGGTGGAACATTTTCTGTACAATAAAGGTGCCGGGCGTTATATCCCAATATCTCAAATG
GTGCTTTTAAGGAACAAGGAACGCGGGAAGCATAAACTGCTGCCCCAACTTAGAGGAATGGAAAATCCTGAGGATTT
TGAAGTCGATGATGAAGGACCCGAAATAACTGAAGAAGAGTACAATAAAGATCCATCATTATATCGGCATGTTTGTT
GGAAGCTGAGAGAAAGAGGAGCGGTTGGAGAAACAATTTTACATCTTTGTTTATTGAATGCCACTTCTCTACATGCA
GACATCGCCAAGAGGCTATTGAGGTTCTATCCCAAATTGATCAACGATATTTACATATCAGATGAATACTATGGTGA
AAATGTTCTACATATCGCCATAGTTAACGAGGATCCTTCCATGGTAAAGTTTCTTCTTGCCGCAAATGTGAACTTTC
AGGAAAGATGTTTCGGTAATTTCATGTGTCCAGAAGATCAGAAATCATCGAGAACTGATTCTCTAGATCACGAATGG
GTGAATGTTTATCACGAAACAAATTATGATGGATATGTGTACTGGGGTGAATATCCATTGTCATTTGCTGCATGTTT
AGGTCAAGAAGAAAGTTTTCGATTAATTTTGGCAAAGGGTGCCAATTTAGATGCACAAGACACTAATGGAAACACTG
TCCTGCATTTATTAGTTATTTATTCCAAAGTGGAAGCTTTCGATATGGCATATGAATTAGGTGCTCACCTTTCAATA
AGGAACATTCTGAAAATGACACCTTTAACGCTGGCCGCCAAGCTAGCAAGAATGGATATATTTTTCCATATTTTAAA
GCTAGAGAGGGAAATATACTGGCAGATAGGAAGCATTACATGTGCCGCCTATCCTCTATCTCAGATTGATACGATAG
ATGTTAAGACTGGACAAATCAGTAAAATGTCAGCGCTGAATCTGGTAGTATTTGGTGATAAAGATGAACATTTAGAA
CTGCTCGATGGAGTATTAGTTGATCTATTAAATGCCAAGTGGAATACGTTTGTGAAATCTAAATTTTACCGGCAATT
TTTTACTTTTGCGTTTTATTTCACCGTATCGCTTGTGGATACCAGCAATGATGATTATGATGTTGAGGAATGGTGGG
ATAATTTACGAGAGGAATGTCGATTAATGAATTTAGACACGACTGAGTCACTAGTGAGATTTACTGCTGAACTTGGA
ATCACGTTTGGTGCATTTCTTTATTTGGCGGCCGCAATGACTGCTCCTTCGAGAGTTATGTTCTTGTTTTCCTGCAT
TTTGGTTTTTGGAGTAATTCCTAGCCTGCGCTTGGTATGCATGGATGAAGTTGAAGATATAATCGCAGTAGTAGTTA
TGCTAACGACGGCTCCATATTTCCTATTTTTCTGTAGAGGCTTTAAAACAGTAGGTCCGTTTGTGGTAATGATCTAT
CGCATGGTTCTAGGCGACTTGCTACGTTTCGCAACTATATACATGGTTTTTGTCATGGGATTTTCTCAAGCATACTA
CATAATTTTCTTGTCTTTTGATAACCCATTGACACCAGAAGACGTCGATGACTCGGCTACGAATCCAATGTCAACTC
CATCCGAATCCATTATGGCAATGTTTTTAATGTCCATGACCAACTTCGGAGATTATTACACAGCATTTGCTAGGACC
GAGCACGAATATGAGGCTAAAATTCTTTTCGTAATATTTATGCCATTGTGGCAATTTGTTAATTAATATGTTAAT
CGCTATGATGGGTAACACATACCAAAAGATAGCGGAAACGCGTAACGAATGGCAGCGACAGTGGGCTCGCATTGTTT
TGGTCGTAGAAAGAGGTGTTAGCCCACCTGAACGGCTCAAGCAATTGAATGTTTATTCACAACCAATGAGCGATGGC
AAAAGAGCTCTCGTTTTAAGGCTCAACCAGTCGGTAAGATATTAG
```

FIGURE 18 - SEQ ID NO: 13

<> 13
<> 2718
<> DNA
<> Harpegnathos saltator
<> gi|307201159
<> ?
>(gi|307201159:26763-26853, 32620-32798, 32877-32964, 33380-33556, 33655-
33844, 34113-34266, 34456-34710, 34779-34861, 34958-35470, 36042-36207,
36369-36630, 38038-38219, 38530-38646, 38749-38874, 38961-39095) Harpegnathos
saltator unplaced genomic scaffold scaffold1583, whole genome shotgun
sequence
ATGGGCAATACCGAGAGCAACGTCACGAGCGGCGTGAAAAAGCAGACGGACACGTCGTCCATCATGCTTTATAAGTT
GGTCGATCTGAAAGGCGGTGGGTTGTTCGTAGACATGATGAAGAGAGCAGCGCAAACTAAGCAGTTCGCAGAGTTGG
ATCACGCGGTGAGAACAAAGGTCGAGCCCTACCTGTACAACAAAGGAAAGGGCAAGTGGATACCCGTGGACAAACTG
GTTCTTCTAAGAAACAAAGATCGTCCGCGACATAAAATGCTGGCACCTTTGAAAGCCATGGAAAATCCGGCGGATTA
CGACATAGATAAGGACATGGGTGATGAAGATGTTGACGAGACTAAAATAGACAAAAGCAAATACAGACTGGTCTGCT
GGGAGCCTGAGCGAGAGAGGCGCTGTCGGTGAAACTATCCTGCACTTGTGCATGTTAAATGCCACTGCTCTCCACGCG
GATCTGGCGAAACGATTGCTACGCTTCTATCCGAATCTCATAAACGACATTTACATAAGCGACGAATACTACGGAGA
GAACGTGCTGCACATCGCGATCGTAAACGAGGACCCAGCGATGGTGAAGTATCTTCTAGACAGCGGTGCGGATGTTC
ACGAGAGGTGCTTCGGTAACTTCATGTGTCCGGAGGATCAGAAAGCGTCAAGGGTTGATAGTCTGGACCACGAGTGG
GTGTGCGTTGCACCGGAGACCAATTACAGCGGATACGTGTACTGGGGAGAATACCCGTTGAGCTTCGCCGCGTGTCT
GGGCCAGGAGGAGTGCTACAGGCTTATGCTCGCCAGAGGCGCGGATCCTGACAAGCAGGACACCAACGGCAACACGG
TTTTGCACATGTTGGTGATATATGAGAAGCTGACTACGTTCGACATGGCGTACGAAGTGGGAGCCTCGTTGGCCATA
AGAAACGTCCAACACCTGACTCCGCTGACGTTGTCAGCAAAGCTGGCCAAGATCGAGATGTTCTTTCACATTCTGAA
CATCGAGAGAGAGATATACTGGCAGATCGGTAGCATAACTTGCGCAGCTTACCCGTTGTCGCAAATAGACACGATCG
ATATTAACATCGGGACTATCAACAAGAACTCCGCCCTGAATTTGGTTGTTTTTGGGGAAAAAGACGAGCATCTAGAA
TTGATGGACGGTATGTTAGTCGACCTTCTGAACGCCAAGTGGAACACTTTCGTTAAGTCTCGATTCTACCGTCAATT
CTTCCTCTTCTGCTTCTACTTCGTGCTGTCGCTGATCAGCTTCACTCTTCGCCCGGGCCCGTTGCCGCAGGAGACCG
AAAATGCGAACGATACGAGAACGAATTCATCGAACGCAACGGCGATGGAGATTCTTAGGTTGTTCCAAAGCTCGGAC
CTGTCGAACCTCGTCACGAACAGCCTCGCCGCGGCTTTTGCCTCGAACCTCAAATCGTCCTTAAACGTGACGCAAGA
ATCGTTGGAGAAGATCCAGCTGCAAGTGACGTCGAACATTACATCGGCCCTGAAGAATATTTTGCCTTCGCTGAGCG
ACAACGAGGGCATCCTGAGTGCCCCTGACGAAGCCGCCATTCGTACGCTGTGGTATACCAGTAGTCCGTACAATGAG
TCAGATTACTTGACAGATGCTTACAACGAGAATGTCACGAGCGATGCGAATTCGACCGCGGGGACGATCATCGGCAG
CATCGAGGTGTCGAAGTCCAACGATAAGGACAATTGGTGGGAAGATCTGACGGAAGAATGCAGGCTGATGCAGCTAA
CGACGATAAGTGCGAAGATCCGGCTGACTGCGGAAGTGCTGATGGAAATCGCCGCGGTGCTCTACATTTTAGCCGCA
CTGCGGGAGGCGAGGTTTTTGGGGCTCAACATGTTCGTCGAGAATCTAATGACAGCGCCGTCGCGCGTCATGTTTCT
CTTCTCGTGCTGCATCTTACTCTCGTTTCCATTTCTGAGATTAGCCTGCGCCGACGAAGTCGAAGACATGTTGGCGG
TCGTGGTGATGCTGACAACGGCACCGTATTTCTTATTCTTCTGCAGAGGCTTCAAGACGGTCGGTCCGTTCGTCGTG
ATGATTTACAGGATGATCATGGGCGACCTCCTCAGATTCGTGTCCATCTATCTGGTCTTCGTCATGGGCTTCTCTCA
AGCGTACTACATTATATTTCTGTCGTTCGACAACCCGAATACCCCGGAAGGCGTCGACGATTCGGTATCGAACCCGA
TGCCGTCGCCGATGGAGAGCATCATGGCGATGTTCCTGATGAGCATGACGAACTTCGGCGACTACTACGGCGCGTTC
GAGCGAACCGAACACGAGTCCGAGGCTAAGCTGCTGTTTGTGTTGTACATGGCGATCGTGGCGATCCTGCTCGTAAA
CATGCTAATTGCTATGATGGGCAACACTTACCAGAAGATCGCCGAGACCAGAAATGAATGGCAAAGACAATGGGCGC
GCATAGTTCTGGTCGTGGAGAGAGGAGTCAGCCCCGCCGAGAGGCTGAAGAAGCTCATGGACTACTCTCAGCCGATG
TCCGGCGGCCGTCGAGCGTTGGTCCTCCGGTTGAATCAAAGTGAGGAGGACAAGGAGGAGATGAAGGAAATACTCGA
GATGAAGAGGACCCACGATAGACTGCTGAAGAAGAGGCAAGGGAGAATGTCAAAGGAGAAAGTTCTGGCCGAGAGCG
AAATTATTATTACCCGAAATTGA

FIGURE 19 - SEQ ID NO: 14

<> 14
<> 2756
<> DNA
<> Nasonia vitripennis
<> XM_001606052.2
<> ?
>gi|345488310|ref|XM_001606052.2| PREDICTED: Nasonia vitripennis nanchung,
transcript variant 1 (Nan), mRNA
ATGGGTAACGCCGAGAGCAACGTCACCAGCGGCGTGAAAAAACAGACGGATGCAGGTGCGATCGCCCTGTACAAACT
CGTTGATCTCAAAGGTGGTGGTCTGCTGGTGGACATGATGAAGCGGGCCTCGCAAACGAAACAGTACGCTGAGATAG
ATCACGCAATTAGGACAAAAGTCGAGCCGTTTCTGTACAACGGAGGCAAAGGCAAGTGGATACCCATAGCGAAACTG
GTGCTCTTGAGGAATAAAGAAAGGGGGAGACACAAAATGTTACCCGTGCTCAAAGCCATGGAGAAGCCCGAGGACTA
CGATATCGATAAGGACATGGCTAACGACCCGGAGCCGGATGAAAACACAATCGACAAGAGTAAATACAAGCTCGTCT
GTTGGACCCTGAGCGCACAGAGGAGCAGTGGGCGAGACGATTCTGCATCTCTGCATGCTCAACGCCACGCAGCTCCAC
GCGGATCTGGCGAAGAGGCTGCTGCGCTTCTATCCGAACCTCATCAACGACATTTACATCGATGACGAATACTACGG
AGAGAACGTCCTGCACATCGCGATAGTGAACGAAGACCCGTCGATGGTGAAATTCCTGCTGGACAGCGGAGCGAACG
TGAACGAGCGTTGCTGCGGCAACTTCATGTGTCCGGAAGATCAAAAGGCTTCTAGGAACGACAGCGTCGAGCATGAA
TGGGTCTGCGTATGCTCGGAAACCAACTACGATGGTTACGTCTACTGGGGCGAGTATCCTTTGAGCTTCGCAGCCTG
TTTTGGATCAGGAGGAATGCTACCGGCTGATACTAGCCAAAGGCGCCGATCCAGATAGCCAGGACACGAACGGCAACA
CCGTTCTCCACATGCTCGTCATTTACGAAAAGCTCGAAACCTTCGACATGGCCTACGAGGTCGGTTCTTCCTTGTCG
ATACGAAACGTCCTGCAACTGACACCTTTAACGCTAGCCGCCAAACTCGCGAGGGTGGAGATGTTCTTCCATATTCT
GAACATCGAGCGCGAGATCTACTGGCAGATCGGTAGCATCACCTGCGCGGCTTATCCGCTTTCTCAGATCGACACTA
TCGACGTGGACACCGGAAAGATCAGCAACAACTCGGCGTTGAATTTGGTCGTTTTCGGTGATAAAGAGGAGCATCTC
AAACTGCTGGAAGGCGTGCTGATCGATCTACTGAACGCAAAGTGGAATACTTTCGTCAAGTCCAGGTTCTACCAGCA
GTTCTACCTCTTCTTCTGTTACTTCATCCTCTCGCTGATAAGCTGCACCCTCCGACCTGGTCCCATAACGAAGACCG
ACGCTCCAACCACGACACCACATCCCATGAACGACACGAGCATCGAGTCCATCACTCCGACCTCGGAACCTTTAGAG
CTGCAGACCTTGTCGTCGCTTCTGGCGAAAAACTTGGCCGAACAACTCGTCATGGGTATGAAGATGTACGGCAACGT
CTCCGAGGACTCACTCGCGAGGATAAGTCTCCAGGTGGCTTCAAACATCAGCGGCTCGATCAAGGACATCTGGACGA
GGCAGAACCTCACGAGCAACGACACCGACTACGTCGATATCGCAGGAGGTCTGTACGCGGACGTCAACGAGACCAGC
GCGAGTGATCCCTTCGATTTGAACGCGAGCGATATCGTGATTCTTAAGAAGGGAAAGAAGGAACTCGATGACTGGTG
GGATGACCTAACCGAAGACTGCCGACTCATGCAGATGAACAGTACCTCGGCGAAAATCCGCCTGACGGCCGAGATAT
TCATGGAATTCGGCGCTATACTTTACATATGCGCTGCGCTCCGAGAGGCGAGGTTCCTCGGGCTCAACATGTTCATC
GAGAATCTCATGACGGCTCCGTCGCGCGTCATGTTTCTCTTCTCCTGCTGCATCCTCCTGTCCTTTCCGTTTCTGAG
GATGTCCTGCGCCGACGAGGTCGAGGACATACTCGCTGTAGTGGTGATGCTCACGACCGCGCCCTACTTCCTCTTCT
TCTGCAGAGGCTTCAAGACCGTCGGGCCCTTCGTCGTCATGATCTACAGGATGATCATGGGTGACCTGCTCAGATTC
GTCTCGATCTATCTGGTCTTCGTCATGGGCTTCTCTCAAGCTTACTACATAATCTTCCTGTCGTTCGACAATCCGAT
CACGCCCGAGGGTGTCGACGACAGCAAAGCTAATCCACTACCGTCAGCCATGGAGAGCATCATGGCGATGTTCCTCA
TGAGCATGACGAATTTCGGCGATTACTACGACGCTTTCGAGAACACCGAGCACGAGATGTTGGCCAAGTGTCTCTTC
GTCGTGTATATGGCCATTGTGTCGGTTCTACTGGTGAACATGCTCATCGCTATGATGGGCAATACCTACCAGAAGAT
CGCTGAAACGAGGAACGAGTGGCAGAGACAGTGGGCTAGGATAGTTCTCGTGGTGGAGAGAGGAGTAGCCCCGGCGG
AGAGATTGAAGAAACTGAACGTTTACTCGCAACCGATGTCCGATGGGCGTAAGGCATTGGTACTGAGGTTGAATCAA
ACTGACAAAGATAAGGAGGAGATGAAGGACATCCTGGAAATGAAGAGGATACACATAAAATCGATAAAGAGACGCAA
GGACAAGCTGCAGAAGGCGAAAGAAGACGCTGAAAAGCTCCAGCAGCAGATGGCCGATAAGGACAATAAGGACAAAG
CCGTTATTATACAATGAGAATTTTTCTATGTATATAATAAAGCGCTCTTGTAAATATATTC

FIGURE 20 - SEQ ID NO: 15

<> 15
<> 2712
<> DNA
<> Megachile rotundata
<> XM_003706124.1
<> ?
>gi|383861395|ref|XM_003706124.1| PREDICTED: Megachile rotundata transient
receptor potential cation channel subfamily V member 6-like (LOC100883930),
mRNA
ATGGGGAACACGGAGAGTAACGTAACTAGCGGCGTGAAGAAACAAACAGACTCCTCTTCTATCTTACTTTACAAGCT
GGTCGATTTAAAAGGTGGTGGTTTATTAGTGGACATGATGAAAAGAGCAACGCAAACTAAACAGTACGCTGAACTAG
ATCACGCTCTAAGAACAAAAGTGGAGCCGTATTTATACAATAAGGGTAAAGGTAAATGGATCCCGATAGAAAAGTTG
GTTCTACTGCGGAATAAAGATCGTCCGAAGCATAAAATGCTTCCACCATTGAGGGCTATGGAGAATCCGGCTGATTA
CGACATAGACAAGGATATGGGCGAGGAAGAAGTGGACGAAACGAAGATAGATAAAAGCAAGTACAGATTGGTCTGCT
GGAGCTTGAGTCAAAGAGGAGCAGTAGGAGAGACGATTATGCATTTATGCATGTTACATGCGACTGCTATTCACACC
GATCTGGCTAAACGTTTACTACGTTTCTATCCTAAGCTCATCAATGACATCTATATCAGTGACGAATACTATGGTGA
AAATGCATTACACATCGCTATAGTGAACGAAGATCCAGCTATGGTAAAGTTCCTTCTAGACAGCGGCGCCGACGTGC
ACGAAAGATGCGTAGGAAATTTTATGTGTCCGGAGGATCAGAAAGCGTCGAGAACAGACAGCGTGGACCACGAATGG
GTTTGCGTGGCTCCCGAAACGAATTACAGCGGATACGTTTACTGGGGTGAATATCCATTAAACTTCGCCGCGTGTTT
AGGCCAAGAAGAGTGCTACAGATTGATACTCGCTAGAGGAGCAGATCCCGACAAGCAAGACACCAATGGAAACACGG
TTCTGCACATGTTGGTGATCTATGAAAAGATGGCCACGTTCGATATGGCGTACGAGGTAGGAGCATCGTTATCGATC
AGAAACGCGCAACATTTGACACCGCTGACGTTATCGGCGAAGCTGGCAAGGATCGAAATGTTTTTTCACATTTTGAA
CATCGAGAGGGAGATTTATTGGCAGATTGGCAGCATTACGTGTGCGGCTTATCCCCTCTCGCAAGTGGACACTATCG
ATGTGAACACTGGTAGCATCAGCCACACTTCCGCCCTGAATCTGGTGGTCTTTGGAGAAAAGGATGAGCACTTGGAA
CTAATGGATGGTACCATGGTTGACCTATTAAACGCGAAGTGGAACACCTTTGTCAAGTCCAGATTTTATCGCCAGTT
CTTCCTATTTTGTTTTTACTTTATTCTTTACTTGATCAGTTTCACTCTTCGACCTGGTCCTTCGGTCACATCGACTG
CTACAACTGCTCCGACTACAGAATCGACCACACCGAAATTGCCAGATCCTCCTCCAAATTTTATTCCAGTTACGAAT
CAAAAAACGTTTCTCGAAGCGAGCCTCTCGTCGTCCTTGGATGAAATTGTGACAAACGCCCTGAATTTAAATTTCCC
TTCGAACGCGACGGCTCGCTTTGACGATCTAAAACTCGATCTCGTAACCCACATAATGTCTAATCTGAAGAACATAT
TGAATGGGAACGAGACCAAAAACGAGCCATTTAACAGCTCCCAACTCGCCAGGTTTGACAAACATTTATTCCGCGAA
AATGACACTGATTATTCTACTAGCATCTTGAACGAGACCGCCGACGTTGATTCCACGACGAAGTTTTCGTTTGACAA
TTCTGTACTGTTTGAGGCTGATAATAAAAGCGATTGGTGGACTGATCTTACCACAGAATGCCGATTAATGCAACTGA
CCACCGCATCCGCGAAGATCCGATTAATCGCAGAAATATTTATGGAAATCGCAGCTATTCTTTACATTCTTGCAGCG
CTAAGAGAGGCCAGGTTTCTAGGTCTCAACATGTTCATCGAAATCTGATGACTGTACCATCGAGAGTAATGTTTCT
CTTCTCCTGTTGCATACTGCTCTCTTTTCCGTTTCTGAGATTATCCTGTGCTGACGAAGTGGAAGATGTGCTAGCAG
TGGTAGTAATGTTGACTACAGCACCATATTTTTGTTCTTCTGCAGAGGTTTCAAAACGGTCGGCCCTTCGTCGTG
ATGATTTATAGAATGATCATGGGCGACCTACTTCGGTTCGTATCCATCTATTTGGTCTTTGTAATTGGATTTTCTCA
AGCTTATTACATCATATTTCTATCTTTTGATAATCCAAACACGCCAGAAGGTGTTGATGATTCAGTGAGCAATCCAA
TGCCATCACCAATAGAAAGCATCATGGCAATGTTTCTAATGAGTATGACGAACTTTGGAGATTACTATGGTGCATTT
GAGAGGACCCGACATGAAATGGAAGCCAAGTTTCTGTTTGTTGTATACATGGCTATTGTTGCTATCTTACTTGTGAA
CATGTTGATTGCTATGATGGGAATACGTATCAAAAAATTGCAGAAACTAGGAATGAATGGCAGAGACAATGGGCAC
GTATAGTTTTGGTAGTAGAAAGAGGAGTAAGTCCTCAAGAAAGGCTTAAAAAATTGATGGATTATTCTCAACCAATG
TCTGATGGCCGCAGAGCATTGGTGCTCAGATTAAATCAATCGGAAGAAGATAAGGAAGAAATGAAGGAGATTTTGGA
AATGAAGAGGACTCATGAGAGATTATATAAAAAGAGGCAACTTAAAACAACAAAAGAAAAGACTACAATAACAGAGG
AGAATGTTACTTTATAG

FIGURE 21 - SEQ ID NO: 16

```
<> 16
<> 2664
<> DNA
<> Apis mellifera
<> XM_625167.3
<> ?
>gi|328787658|ref|XM_625167.3| PREDICTED: Apis mellifera nanchung (Nan), mRNA
ATGGGAAATACGGAAAGCAACGTAGCCAGCGGAGTGAAGAAACAGACGGACGCATCGTCCATTTTGCTTTACAAATT
GGTCGACTTGAAAGGTGGTGGCCTATTGGTGGATATGATGAAAAGGGCAACGCAAACTAAACAGTACGCGGAATTGG
ACCATGCCCTGAGAACAAAAGTAGAGCCATATTTATATAACAAGGGTAAAGGTAAATGGATCCCGATCGAGAAATTG
GTTTTGCTGAGAAACAAAGATCGTCCAAAGCACAAAATGCTTCCACCGTTGCGAGCTATGGAAAATCCGGCCGATTA
CGACATAGACAAAGATATGGGCGAAGACGAGGTGGACGAGACGAAAATAGATAAAAGCAAGTACAGATTAGTGTGCT
GGAGCTTGAGCGAGAGAGGAGCGGTCGGTGAAACGATTCTACATTTGTGCATGCTACACGCAACTGCTATTCACATC
GATTTGGCTAAACGTTTGCTACGTTTTTATCCCAAGCTTATCAACGATGTGTACATAAGCGACGAGTATTATGGCGA
GAGCGCGTTACACATCGCGATTGTAAACGAGGACCCGTCAATGGTAAAATTCCTTTTGGATAGCGGTGCGGACGTGC
ACGAGAGATGCATAGGAAACTTTATGTGTCCAGAGGATCAAAAAGCGTCGAGGGCGGACAGTCTTGATCACGAATGG
GTTTGCGTAACTCCGGAAACCAATTACAACGGGTACGTTTACTGGGGCGAGTATCCTTTAAATTTTGCTGCGTGCCT
GGGACAGGAAGAGTGTTACAGATTGATACTCGCAAGGGGAGCCGACCCCGACAAGCAAGATACGAACGGAAATACCG
TTTTACACATGTTGGTCATTTACGAAAAATTGGCCACGTTCGACATGGCGTACGAGGTGGGAGCATCGTTGGCCATC
AGGAATGCCCAACACTTAACGCCCTTGACATTGTCGGCGAAATTGGCGAAGATCGAGATGTTTTCCACATTTTAAA
CATCGAGCGAGAGATTTATTGGCAGATCGGAAGCATAACGTGCGCAGCTTATCCTCTCTCGCAAGTCGACACCATCG
ATGTCGACACGGGAAGCATTAGTCATAATTCCGCTCTAAATCTGGTCGTATTCGGCGAAAAAGATGAGCATTTGGAA
TTGATGGACGGAATCCTGGTCGATCTGTTGAACGCCAAATGGAACACGTTCGTCAAATTTCGCTTTTACCGCCAATT
TTTCCTCTTTTGCTTCTACTTCGTCCTGTCGTTGATCAGTTTCACCCTTCGACCCGGCCCAGCAACAACATCGTCCG
TATCCAATCCTCAGATCACGTCCACCGAATTGCCCACAATTCCCCAAAAATGGATCCACCCGTCCACAATTCCGAT
CTCCCCCTCCTCCTTGACAAAATTCTTTCCACCGCTCTCGTCTCGAAAAGGTATCCTTGGAATTTGACGAGAACGCG
TCTCGACAAGCTGAAGCTCGATATCGTGGAGAACTTGACATCCGCTTTGAGCGATATGCTCGGGACATACCGAAACG
AGATCAAATTGTTTAACCGTTCTGACAAAACGTCCATCTACTCGTCTAGAAACGACGCTAAACCGATCGACGAGACT
GTCCTCCGGATAAATTCGACGATCCTGTTCAACGGCGATGGGATATCGTTTACCAGCAAGTACAATTGGTGGAACAA
TCTTACAGAGGAATGCAGACTCATGCATCTAGATACGTTATCGACAAAGATTAGATTGACTGCCGAGGTATTAATGG
AAATTGCGGCCACTCTTTATATTTTTGCAGCATTGCGCGAAGCCAGATTTCTAGGTCTTAATATGTTTATAGAAAAT
CTAATGACCGCACCGTCCAGAGTGATGTTCCTCTTCTCATGCTGTATATTGTTAACCTTCCCGTTTCTAAGATTGAT
CTGCGCCGACGAAATTGAAGATATGTTAGCCGTGGTCGTCATGCTCACCACGGCACCGTATTTTCTATTCTTCTGCA
GAGGTTTCAAAACGGTCGGCCCATTCGTCGTGATGATTTACAGAATGATCATGGGCGATCTGCTACGTTTCGTCTCC
ATTTACTTGGTCTTCGTGATGGATTTTCCCAAGCATACTACATTATATTTTTATCTTTCGATAATCCAAACACACC
GGAAGGAGTAGACGATTCGATGAGCAATCCGATGCCATCACCAATAGAAAGTATAATGGCGATGTTTCTTATGAGCA
TGACAAACTTTGGAGATTATTATGGTGCTTTTGAAAGAACGCAACACGAGATGGAAGCCAAATTCTTATTTGTAGTT
TACATGGCTATCGTTGCTATATTATTGGTAAATATGTTAATTGCCATGATGGGGAATACATATCAGAAAATTGCAGA
AACGAGAAATGAATGGCAAAGACAATGGGCACGCATAGTTTTAGTAGTTGAAAGAGGAGTGAGCCCTGATGAAAGAC
TTAAAAAATTAATGGATTATTCTCAACCAATGTCTGATGGTCGAAGAGCATTGGTACTTCGATTGAATCAATCGGAA
GAGGACAAAGAAGAAATGAAGGAAATTCTAGAGATGAAAAGAACTCATGATAAATTATACAAAAGAAGACAGAGCAA
AACAATGAAAAGATTTTAACATCAGAAGATAATGTTATTTTATAA
```

FIGURE 22 - SEQ ID NO: 17

```
<> 17
<> 2739
<> DNA
<> Apis florea
<> XM_003689958.1
<> ?
>gi|380011848|ref|XM_003689958.1| PREDICTED: Apis florea transient receptor
potential cation channel subfamily V member 5-like (LOC100863041), mRNA
ATGGGAAATACGGAGAGCAACGTGGCCAGCGGTGTGAAGAAACAGACGGACGCGTCGTCCATTTTGCTTTACAAATT
AGTCGACTTGAAAGGAGGTGGTTTATTGGTAGATATGATGAAAAGGGCAACGCAAACTAAACAATACGCGGAATTGG
ATCACGCACTGAGAACAAAAGTAGAACCGTATTTATATAACAAGGGTAAAGGTAAATGGATCCCGATCGAGAAATTG
GTTTTGTTGAGGAACAAGGATCGTCCAAAGCACAAAATGCTTCCACCGTTGCGGGCTATGGAAAATCCGGCCGATTA
CGACATAGACAAAGATACGGGCGAAGATGAAGTGAGGGACGAGACGAGAATAGATAAAAGCAAGTACAGATTAGTAT
GCTGGAGCTTGAGCGAGAGAGGAGCAGTCGGTGAAACAATTTTACATTTGTGTATGCTACATGCAACTGCTATTCAC
ATCGATTTGGCTAAGCGTTTGCTACGTTTTTATCCCAAGCTTATCAACGATGTTTACATAAGCGACGAGTATTATGG
CGAGAGCGCATTACACATCGCAATCGTGAACGAGGATCCGTCAATGGTGAAATTCCTTTTGGATAGCGGTGCGGACG
TGCACGAAAGATGCATAGGAAACTTTATGTGTCCAGAGGATCAAAAAGCGTCGAGAGCGGACAGTCTGGATCACGAA
TGGGTTTGCGTAACTCCGGAAACTAATTACAACGGGTACGTTTACTGGGGCGAGTATCCTTTAAATTTTGCCGCGTG
TTTGGGACAGGAAGAGTGTTACAGATTGATACTCGCGAGGGGGCTGACCCCGACAAACAAGATACGAACGGGAACA
CCGTTTTACACATGCTGGTCATTTACGAAAAATTGGCGACATTCGATATGGCGTACGAAGTGGGCGCATCGTTAGCG
ATCAGGAATGCTCAACACTTAACGCCCTTGACGTTGTCGGCCAAATTGGCAAAGATCGAAATGTTTTTTCACATTTT
GAACATCGAGCGAGAGATTTATTGGCAGATCGGAAGTATAACGTGCGCAGCTTATCCTCTCGCAAGTCGACACCA
TCGATGTCGACACGGGAAGCATTAGCCACAATTCCGCTCTAAATCTGGTCGTGTTCGGCGAAAAAGACGAGCATTTG
GAATTGATGGACGGGATTCTGGTTGATCTGTTGAACGCCAAGTGGAACACATTCGTCAAATTTCGGTTTTATCGTCA
ATTTTTCNCTTTTTGTTTTTACTTTGTCCTGTCGTTGATCAGTTTCACCCTTCGACCTGGCCCAGCGACGACATCAT
CCGTTCCCAACCCCGTCGCTCAAACGCCCCTTACGTCCACCGAATTGTCCACAATTTCCCCAAAAGTGGATCCTCCC
GTCTCGAACGTTACTGTCAATCGAAGCTCGAATGCTTTCCAACACGATTCCAATCTCTCCCTCCTTCTTGATAAAAT
TCTTTCCACTGCAAGCGTAAAATATCCTTGGAACGTGACAAGAACTCGTCTCGATAAGCTGAAGCTCGATATCATCG
AGAATTTGACAACCGCTTTGAACAATCTACTGTCGACACACCGAGACGAGATCGAATTTTTTAACCACTCTTACAAA
ACAACCGAATATTTCCATTCTACGAGAAACGATACCACGCCGATCGATAATTTGAAAATTACGATCAATGAAACTGT
CCTTTCGGTAAATTCGACGATTCTGTTCAACGATGGGAATATCGTTTGCCACTGGCAAATACAACTGGTGGAACAATC
TTACAGAAGAATGTAGACTAATGCATGTAGATACGTTATCGACAAAGATTAGATTGACTGCTGAAGTATTAATGGAA
ATTGCGGCCACTCTTTACATTTTTGCAGCATTGCGAGAAGCCAGATTCCTTGGTCTTAATATGTTCATTGAAAATCT
AATGACTGCACCGTCCAGAGTGATGTTTCTCTTTTCCTGCTGTATATTGTTAACCTTCCCATTTTTAAGATTGATTT
GCGCCGACCAAGTTGAAGATATGCTAGCTGTTGTCGTTATGTTAACCACGGCACCGTATTTCTTATTTTTCTGTAGA
GGTTTCAAAACGGTCGGCCCATTCGTCGTGATGATTTACAGAATGATCATGGGCGATCTCCTCCGTTTCGTCTCCAT
TTACTTGGTCTTCGTGATGGGATTTTCCCAAGCATACTATATTATATTTTTATCTTTCGATAATCCAAATACACCGG
AAGGAGTAGATGATTCGATGAGCAATCCAATGCCGTCACCAATAGAAAGTATAATGGCAATGTTTCTTATGAGCATG
ACAAACTTTGGAGATTATTATGGTGCTTTTGAAAGAACGCAACACGAGATAGAAGCCAAGTTTTTATTTGTAGTATA
CATGGCGATCGTTGCTATATTATTGGTAAATATGTTAATTGCCATGATGGGAAATACGTATCAGAAAATTGCAGAAA
CAAGAAATGAATGGCAAAGACAATGGGCACGTATAGTTTTAGTAGTTGAAAGAGGAGTGAGCCCTGAGGAAAGACTT
AAGAAATTAATGGATTATTCTCAACCAATGTCCGATGGTCGAAGAGCATTAGTACTTCGATTGAATCAATCGGAAGA
GGACAAAGAAGAAATGAAAGAAATTCTAGAGATGAAAAGAACTCATGATAAATTATACAAAAAAGACAGAGCAAAA
TAATGAAAAGATTTTAACATCAGAGGATAATGTTATTTTATAA
```

FIGURE 23 - SEQ ID NO: 18

<> 18
<> 2472
<> DNA
<> Pediculus humanus corporis
<> XM_002427918.1
<> ?
>gi|242014576|ref|XM_002427918.1| Pediculus humanus corporis conserved
hypothetical protein, mRNA
ATGGGAAATACAGAGAGTAACGTTACGAGTGGTGTAAAAAAACAAGCGGGAACATCCGAACAACCATTGTACAAATT
AGTCGGTTTAAAAGGTGGAGGTCTTTTGGTCGACATGATGAAAAGAGCGACACAAACGAAACAATATGCTGAATTAG
ATCACGCGATCAAAACAAAAATTGAACCTTTTTTATATAACAAAGGAAAAGGAAGATTGATACCCATATCACAGTTG
GTACTTTTAAGAAACTGCGAAAGATCTAGAACAAAATTGCTTCCGCTTCTTAAAAACATGGAAGATCCAGAATCTGA
ATTTGACATGGATCGTGATGGAAATCCTGGAGATTTTCAACCGGCTCCAGATGGCGTACAAGAAGATTTTCACGATT
ACAATAAAAAATATAGAGACGTTTGTTGGGATTTGAAAAAAAGGGGAGCCGTGGGAGAAACATGCCTTCACCTGTGC
ATGCTTAATGCCACGTCAATCCACGCGGATTTAGCTAAAAGATTATTAAAATTTTATCCGAAACTTATAAATGACAT
TTACATGTCGGACGAATATTACGGTGAAAGCGTTCTTCACGTGGCAATAGTAAATGAAGATCCTGCCATGGTTAAAT
ATTTACTCGATAGCGGTTCTAATTTTCACGAACGTTGTTTTGGAAATTTCATGTGTCCAGAAGATCAAAAAGCAACA
AGAACGGATTCTCTCGATCATGAATATGTTAATTTATCAACGGAAACTAATTACGAAGGATACGTTTATTGGGGAGA
ATATCCGTTAAGTTTTGCAGCTTGTTTGGGACAAGAAGAAAGTTATCGTTTGATGCTTGCCAAGGGTGCCAATCCCG
ATAATCAAGATACAAATGGCAACACTGTTTTACACATGCTCGTCATACATAATAAATTGCCCATGTTTGACGTGGCT
TATGAAGTTGGCGCCAATTTATCGTTAAAAAATGCAAATGTCTAACGCCACTTACACTTGCGGCAAAATTAGCAAG
AGTCGAACTTTTTTTTCATATTTTAAACATAGAAAGAGAAATTTATTGGCAAATAGGGAGCATAACGTGTGCGGCAT
ATCCGTTATCACAAATCGATACGATTGATATCGAAACCGGAAACATAAGTAAAAATTCAGCGTTAAATTTAGTCGTT
TTCGGAGAAAAAGACGAACATTTAGAACTCATGGATGGAGTATTGGTAGATTTATTAGTCGCAAAATGGAACACCTA
CGTTAAATTCAGATTCTACAGGCAATTTATATCTTTTTTTTCTATTTTCTTATCTCTGTTATCTGTTTTACACTTC
GACCCGGTCCTCCGACAGGAACAACAACAACAAACGGTATCGTCGTTTTAAATAATAATAACAACAACATAACG
TCCGTTGTTGATAATTCAAATAACGTTACCACCACCACCGCCACAACTACTGCCACGTCATATTCTTTTCCTGGTCA
CGTGATAGTGACACTTTTATCGTATGATAAATACGAAGATAAAATACGTATAATATCAGAATTAGCGATGGAAATCG
GATCTGTTTTGTATTTGTTAGGAGCATTGAGAGAAGCTAAATTTTTAGGGATTCACATGTTTATTGAAAATTTGATG
ACAGCTCCGTCGAGAGTTTTATTTTTAGGTTCTTGTTGCATAATGCAATTCGTACCTTGGCTCAGGATCACGTGTAA
AGAAGAAACGGAAGATATCGTTGCCGTTATCATTATGTTAACGACGGCTCCATATTTTTATTTTTTGCAGAAAAA
TGAACGACCCCGTTTTCTTTTCTTTTTTTTTAATAAAAAAAATTTTTTTTCTAATTTTTTTTTTTTTTTTTT
ACAAAGCCAACTTATTATATAATATTCCTTTCGTTTGATAATCCAAAAACTCCCGATGGAGTCGACGATTCTGGAAC
AAATCCAATGCAAAGCCCAGTTGAATCCATAATGGCAATGTTTTTAATGTCTCTGACAAATTTTGGAGAATATTACG
GTGCATTCGAAAAGACTGAACACGAATTTGTTGCAAAGTTAATGTTTGTCGTTTACATGGCTATCGTTGCTATATTA
CTCGTTAACATGTTGATCGCCATGATGGGTAATACGTATCAAAAAATAGCAGAAACGAGAAACGAATGGCAAAGACA
ATGGGCAAGAATTGTTTTGGTTGTTGAAAGAGGTGTGAGTCCTCAAGAAAGGTTAAAAAAATTAATGCTTTATTCTC
AGCCTATGTCTGACGGAAGAAGAGCATTAGTTTTACGATTGCATCAAACGCCAGAAGACAAAGAAGAAATGAAAGAA
ATATTAGATATGAAAAGAATACACAATAGAACGGTTCAAAGGCGAAAAGCTAAAGAAAATAAAAATGTCACGTTTGC
TGGTACCCCTAAAAATGGCATTAAAAATCGTTTGCTCGGTCCCGTTCCCCCATTAAAAAGCATACCGTCAAAACCTA
AAATTTAA

```
FIGURE 24 - SEQ ID NO: 19

<> 19
<> 1068, partial
<> DNA
<> Danaus plexippus
<> gi|357621160
<> ?
>(gi|357621160:c3951-3760, c3525-3397, c3296-3158, c1274-1085, c586-433,
c334-71) Danaus plexippus, whole genome shotgun sequence
ATGCTGGAGTCAGGAGGTGGTTTACTTGTGGACATGATGAAGAGGGCGGTTCAGAATAAGCAGTACGCTGAGATAGA
CCACGCTATCAAGACTAAGGTGGAGCCCTTTCTCTACAATAAGGGCAAGGGCAGGCATATCCCTATATCGCATCTTG
TGCTGTTGAGGAATAAGGAACGAGGGAGGCATAAATTGCTGCCACCGTTACGTGGCATGGAGAATCCTGACGAAGAG
TTTGATGTAGAGAAGGATTGGCCAGTTGTGACCCAGGAAGAATACGAGGCGAATCCCTCGGCTTACAGGGAGCTTTG
CTGGGACCTGAAGGAACGCGGTGCCGTCGGTGAGACAATCCTTCACCTTTGTCTTCTAAACGCTACCTCACTTTTAG
CTGATTTAGCCAAGAGATTGCTTCGTTTTTACCCAAAACTTATAAACGACATTTACATGAGCGACGAGTATTACGGT
GAGAGCGTACTTCATATGACTATTGTAAACGAGGACCCGACTATGGTGAAATTTCTTTTGGATTCCGGAGCTGATTA
TCATGAACGTTGCTTCGGGAACTTCATGTGTCCTGAGGATCAGAAGGCCTCCCGAACAGATTCCTTCGACCACGAGT
GGGTCAACGTCCAGCCGGACACCAACTATGACGGGTACGTATATTGGGGGGAATACCCTTTAAGTTTCGCGGCCTGT
CTCGGTCAGGAGGAGTGCTACAGGCTCATACTGGCAAGAGGAGCGAACCCCGACAAACAGGACACCAATGGCAACAC
CGTACTGCATATGCTGATCATTTATGATAAAATAAGCACATTCGATATGGCGTATGAAGTTGGTGCATCCCTAAACA
TCAGGAACGTTCAGAACCTAACACCGCTCACCCTGGCCGCTAAACTGGCGAGAGTTGAGCTGTTCTTCCATATCCTG
AACATTGAAAGGGAGATCTATTGGCAAATCGGAGCCACCACCTGTGCAGCGTATCCTCTGGGACAAGTTGACACTAT
TGACACCGAGACCGGAAGGATTAGTAAAGATTCGGCGCTGAATTTAGTTGTATTTGGGGTTAGTTAG
```

FIGURE 25 - SEQ ID NO: 20

<> 20
<> 2583, partial
<> DNA
<> Solenopsis invicta
<> gi|322788678
<> ?
>(gi|322788678:c>387241-387065, c386978-386891, c385583-385407, c384935-
384734, c384460-384325, c384092-383838, c383766-383684, c383540-383034,
c382274-382109, c381583-381322, c379659-379478, c379232-379116, c378734-
378609, c378544-<378440) Solenopsis invicta unplaced genomic scaffold
Si_gnG.scaffold05712, whole genome shotgun sequence
GGCGGATTGTTAGTGGATATGATGAAGAGAGCCTCTCAGACCAAGCAGTACGCGGAGTTGGATCACGCGATGAGAAC
GAAGGTCGAGCCGTTTTTGTACAACAAAGGAAAGGGCAAATGGATACCCATAGAAAAATTGGTCCTCCTACGAAATA
AGGATCGTCCGCGACATAAAATGCTACCACCTTTGAAAGCCATGGAAAATCCAGCGGATTACGATATCGATAAGGAT
ATGGGCGATGAGGAAGTCGACGAAGCTAAGATAGATAAAAGCAAATATAGGCTGGTGTGCTGGAATCTGAGCGACAG
AGGTGCCGTCGGCGAAACCATTTTGCATTTGTGCATGTTGAACGCGACAGCCATCCACGCCGATTTGGCGAAACGAC
TGTTGCGTTTCTATCCTCTGCTTATATACGATATTTATTTGTGCGACGAGTATTACGGGGAGAATGTCTTGCACATC
GCTATCGTTAACGAGGACCCGTCGTTGGTCAAGTTTCTTCTGGATAGTGGAGCGGACGATCCGCGCATTATCCACGA
AAGGTGCTTCGGCACCTTCATGTGTCCGGAGGACCAGAAGGCGTCGAGGTTTGACAGTATGGACCACGAGTGGGTGT
GCGTCACACCGGAGACCGATTACAATGGCTATGTGTACTGGGGAGAATATCCGTTGAGTTTCGCCGCATGCCTCGGT
CAGGAAGAGTGCTACAGGCTTATACTAGCCAGAGGCGCGGATCCTGATAAGCAGGACACGAATGGCAACACCGTTTT
GCACATGCTGGCTACGTTCGACATGGCTTATGAGGTAGGAGCTTCTCTCGACATAAGAAACGTTCAACACCTAACTC
CGTTGACCTTAGCAGCAAAGTTGGCCAGGATCGAGATGTTCTTTCACATCCTGAACATCGAAAGAGAGATATACTGG
CAAATCGGTAGTATAACTTGCGCAGCCTACCCTTTATCGCAAATAGATACGATCGATGTTAACACGGGGACAATTAA
CAAAACTTCTGCCCTGAATCTGGTTGTTTTTGGCGACAAAGATGAACATTTAGAGTTGATGGACGGAATGCTAGTCG
ATCTGCTAAACGCCAAGTGGAACACTTTCGTTAAATCTCGATTTTACCGTCAATTCTTCCTCTTCTGCTTCCACTTC
GTGCTGTCGCTGATTAGCTTCACTCTTCGCCCTGGCCCGTCGACCATGGAAACAGATGAAAACGCGAACGATACGTC
GACGAAGACAAATTCTTCAAATATAACAGAGCCCATAATTCTCAAGCCCCTCCAAAGCTCGGATCTGTCGGAACTGG
TTACGAATAGCTTCGTGGCGGCTTTTGCGTCGAATCTCAAGTCATCCTTAAACATGACGCAGGAATCATTGGAGAAA
ATCCAGCTGCAAGTAACATCGAATATCACATCGGCCTTGAAGAGCATTTTGCTCTTGACGTTGAACGAAAACGAGGG
CATTCTGAGTCCTCCTGACGAGGCCACCATCCATACGCCGTGGTATACCGACAGCTCTCCAAATACGTCGGACTATT
TCACAGATCTCTACAATAAAACTGTCGTAGCCGAAAATTCGACTGTCAAGGCAGTTGTCGATGACGTCGCGCAAACC
GATTACTGGTGGGACGATTTCGCCGAGGAGTGTAGACTGATGCAGCTAACAGAAACGAGTGCGAAGATTCGTCTAAC
TGCGGAAACTTTTATGTACATCGCAGCGGTGCTTTATATCTTGGCTGCATTGAGGGAGGCGAGATTTTTAGGTCTCA
ACATGTTCATCGAAAATCTCGCGACGGCGCCATCGCGCGTGATGTTTCTGTTCTCGTGCTGTATCCTGCTGTCGTTC
CCATTTTTGCGATTTGTCTGCGCGGACGAGATCGAAGACATACTGGCGGTCGTGGTGATGCTGACGACCGCGCCGTA
CTTTCTGTTCTTCTGCCGGGGCTTCAAGACGGTCGGGCCGTTCGTCGTGATGATTTACAGGATGATCATGGGCGACC
TCCTCAGATTCGTCTGCATCTACCTTGTCTTCGTTATGGGATTCTCCCAAGCGTACTACATCATATTCCTGTCGTTC
GACAATCCGAACACTCCGGAGGGCACCGACGACTCGATAACGAATCCGATGCCGTCGCCGATGGAGAGCGTCATGGC
GATGTTCCTGATGAGCATGACGAACTTCGGAGATTACTTTGGCGCGTTTGAAAGAACCGAGCACGAGTTCGAGGCCA
AGCTGCTGTTCGTGTTGTACATGGTGATCGTGGCGATCCTGCTCGTAAACATGTTGATCGCCATGATGGGCAACACT
TACCAGAAGATCGCCCGAAACCAGGAATGAATGGCAGCGGCAATGGGCGCGGATAGTTTTGGTCGTGGAGAGAGGTGT
CAGTCCCGCTGAAAGGCTGAAAAAATTGACAGACTATTCTCAGCCCATGTCCGACGGCCGTCCTGCGTTGGTTCTTC
GATTACATCAAACTGAGGAGGACAAGGAAGAGATGAAGGAGATACTCGAGATGAAGAGAACCCACGAAAAATTGCTG
AAGAAAAGACAATGCAGGATGTCAAAGGAGAAGATTCTGTCT

FIGURE 26 - SEQ ID NO: 21

<> 21
<> 2586
<> DNA
<> Acromyrmex echinatior
<> gi|332030918
<> ?
>(gi|332030918:309691-309781, 317981-318159, 318242-318329, 319179-319355,
319934-320135, 320432-320567, 320999-321253, 321328-321410, 321580-322092,
322373-322538, 323028-323289, 324761-324942, 325161-325277, 326205-326339)
Acromyrmex echinatior unplaced genomic scaffold scaffold115, whole genome
shotgun sequence
ATGGGTAATACCGAGAGCAATGTTGCGAGCAGCGTGAAGAAACAAACGGATACGTCGTCCATCCTGCTCTATAAATT
AGTCGACTTGAAGGGTGGCGGATTGTTGGTGGACATGATGAAAAGAGCCACGCAGACTAAGCAGTTTGCAGAGTTGG
ATCACGCGATGAGAACCAAAGTAGAACCGTTTCTGTACAACAAGGGAAAAGGCAAGTGGATACCAGTGGACAAATTA
GTTCTTCTACGAAATAAAGATCGTCCGCGGCATAAAATGCTACCGCCTTTAAAAGCTATGGAAAATCCAGCTGATTA
CGATATCGATAAAGACATGGGCGACGAGGAAGTTGATGAGGCCAAGATCGATAAAAGCAAATATAGACTGGTATGTT
GGAATTTAAGCGACAGAGGTGCTGTTGGCGAAACTATCTTGCATTTGTGCATGTTGCACGCGACCGCCATTCATGCT
GATTTGGCAAAACGACTGTTGCGTTTCTATCCGAAGCTTATAAACGATATTTATCTAAGCGATGAGTACTATGGAGA
GAATGTCTTGCACATCGCTATTGTAAACGAGGATCCATCGATGGTTAAGTTCCTTCTCGACAGCGGAGCAGACGATC
CGTGCATTATCCACGAGAGGTGCTTCGGCAACTTCATGTGCCCAGAAGATCAGAAGGCGTCGAGGTTTGACAATATG
GACCACGAGTGGGTGTGTGTTTCACCGGAAACCAATTACAACGGTTATGTGTACTGGGGAGAATATCCGTTAAGCTT
CGCCGCATGTCTCGGTCAGGAAGAGTGCTACAGGCTTATATTAGCCAGAGGTGCAGATCCTGATAAGCAGGACACGA
ATGGCAATACCGTTATGCATATGCTAGCCACGTTCGACATGGCTTATGAAGTAGGAGCTTCTCTCGGCATAAGAAAC
GTTCAACATCTGACTCCGTTGACTTTGGCTGCAAAGTTGGCCAGGATTGAGATATTCTTTCACATCATGAATATCGA
AAGAGAGATATACTGGCAAATCGGTAGCATAACTTGCGCAGCCTACCCTTTATCGCAAATAGATACGATCGACGTTA
ATACGGGCACAATCAACAATAATTCCGCCCTGAATCTGGTTGTTTTGGTGATAAAGATGAACATTTAGAGTTAATG
GACGGTGTGTTAGTCGATCTTTTAAATGCCAAGTGGAACACCTTCGTTAAATCCCGATTCTACAATCAATTCTTTCT
TTTCTGCTTCTACTTCGTACTATCGCTGATTAGCTTCACCCTTCGACCTGGCCCATCAACCATAGAAACAGACGAAA
ATGCAAATGATACGTCGACGAGGACAAATTCCTCCAACATAACGGAGCCTATAATTCACAAGACTCTCCAAAGCTCG
GATCTGTCAGAATTGGTTACGAATAGTCTCGTAGCGGCTTTTACCTCGAATTTTAAATCATCCTTAAATATGACGCA
GGAATCGCTAGAAAAGATCCAGCTACAAGTAACGTCAAACATCACGTCAGCCCTGAAGAGCATTTTGCTCTTGACGT
TGAACGAAAATGAGGGCATTCTGAGTCCTCCTGACGAGGCCACCATTCATACGCTGTGGTATACCGATAGCCCTCCA
AACGCGTCGGATTATTTTATGAATACTTACAACAAAACCGACGCGAATTCAACTGTCAAGACAATTATCGACGGCGT
CGCGCGACCAAAATTTAAAAGCAATTATTGGTGGACGATTTCTCGGAGGAGTGCAGACTCATGCAGCTATCAGAAA
TGAGTGCAAAAATTCGTCTAACTGCGGAAATTTTTATGTTCATCGCAGCGGTGCTCTACATTTTGGCTGCGTTGCGG
GAGGCGAAATTCTTAGGTCTTCATATGTTCATCGAAAATCTCATGACGGTGCCGTCACGCGTGATGTTCCTGATCTC
GTGCTGCATCCTGATGTGGTTCCCGGTTCTGCGATTTACTTGCTCCGACGAGGTCGAAGATATGCTAGCAGTCGTAG
TGATGCTGACGACGGCGCCATACTTTTTATTCTTCTGCCGGGGCTTCAAGACGGTCGGACCGTTCGTCGTGATGATT
TACAGGATGATCATGGGTGATCTCATCAGATTCGTCTCTATCTACCTCGTTTTTGTCATGGGATTCTCTCAAGCATA
TTACATCATATTCCTGTCATTCGACAACCCGAATACTCCAGAGGGCATCGACGACTCTATCACGAATCCGATGCCAT
CGCCGATGGAAAGTGTTATGGCGATGTTCCTGATGAGCATGACGAATTTCGGTGATTACTTTGGCGCGTTTGACAGA
ACCGAGCATGAATTCGAGGCCAAGCTGCTGTTTGTATTGTACATGGCGATTGTGGCAATCTTGCTCGTGAACATGTT
GATCGCTATGATGGGCAACACTTACCAGAAGATCGCTGAAACCAGGAACGAATGGCAACGGCAAGAGGAAGACAAGG
AAGAGATGAAGGAGATACTCGAGATGAAGAGAACCCATGATAGATTGCTGAAGAAAAGACAAAATAGAATGTCAAAG
GAAAAGATTATATTTGAAACAGAACCTATTATTACCAAGAATTGA

FIGURE 27 - SEQ ID NO: 22

<> 22
<> 2715
<> DNA
<> Camponotus floridanus
<> gi|307175924
<> ?
>(gi|307175924:c183397-183307, c179197-179019, c178952-178865, c178703-
178527, c177969-177768, c177459-177324, c177108-176854, c176778-176696,
c176511-175996, c175760-175595, c175215-174954, c174185-174004, c173751-
173635, c173554-173429, c173364-173230) Camponotus floridanus unplaced
genomic scaffold scaffold967, whole genome shotgun sequence
ATGGGTAATACAGAGAGTAATGTTACGAGCGGTGTAAAGAAACAAACGGACACATCGTCCATCGTGCTTTATAAATT
AGTCGATTTAAAAGGTGGTGGTTTGTTAGTTGATATGATGAAAAGAGCCACTCAGACAAAGCAGTTTGCGGAATTAG
ACCATGCGATGAGAACGAAAGTCGAGCCCTTTTTATATAACAAGGGGGAAGGCAAATGGATACCTATAGACAAATTG
GTCCTCTTACGAAATAAAGATCGTCCGCGACACAAAATGCTAGCACCGTTAAAAGCTATGGAAAATCCAGCGGATTA
CGATATAGACAAAGATATGGGCGATGAGGAAGTTGATGAAACTAAGATAGATAAAAGCAAATATAGATTAGTGTGCT
GGAATTTGAGTGAGAGAGGTGCTGTCGGCGAAACTATTTTGCATTTATGTATGTTAAACGCTACTGCTCTCCACGCT
GATTTGGCAAAAAGACTATTACGTTTCTATCCGAAGCTTATAAACGATATTTATCTATGCGACGAATATTACGGTGA
AAATGTATTACATATTGCTATTGTGAACGAGGATCCATCGATGGTCAAGTATCTTCTCGACAGCGGCGCGGACGACC
CGCGCATTATCCACGAGAGATGCTTCGGTAATTTTATGTGTCCGGAAGATCAGAAAGCATCGAGGTTTGATAGTCAA
GATCACGAATGGGTGTGCGTCACACCAGAAACCAATTATAACGGATACGTGTATTGGGGAGAGTATCCCTTGAGCTT
TGCCGCATGCCTTGGTCAGGAAGAATGCTACAGACTTATACTTGCCAGAGGTGCGGATCCGGATAAACAGGATACGA
ATGGGAACACCGTTTTACATATGCTGGCTACGTTCGATATGGCCTATGAAGTGGGGCTTCTCTAGACATAAGAAAC
GTTCAACATCTGACTCCATTGACTTTGGCAGCAAAGCTAGCTAGGATAGAGATGTTCTTTCACATTCTGAATATCGA
GAGAGAGATATACTGGCAAATAGGTAGCATAACTTGCGCAGCCTATCCTTTGTCGCAAATAGATACAATAGACGTTA
ATGCAGGAACAATCAACAATAATTCTGCTCTAAATTTGGTTGTTTTTGGCGAGAAAGATGAACATTTAGAGTTAATG
GACGGCGTCCTAATCGATCTTTTAAATGCCAAGTGGAACACTTTTGTTAAATTCCGATTCTATCGTCAATTCATTCT
CTTCTACTTCTACTTTGTGCTATCGCTGATTAGTTTCACTCTTCGTCCTGGCCCGCAAACAGATGAAAATGCGAATG
ATACATTGACAAACTCATTCAACACGACGAGGGAATCCATGATTCTCAAGTCTCTTCACAGTTCGGATCTATCAGAA
CTGGTTACAAATAGTTTCACAGCAGCTTTTACTTCGAACTTCAAATCATCCTTAAACGTAACGCAAGAGTCATTGGA
GAAGATCCAGCTGCAAGTGACGTCGAATGTTACATCTGCTCTGAGAAGCATTTTGCTTTTAACGTTGAGCAACAATG
AGGATCTTTTGAGTTCCCCTGATGAGGCCGCCATTCATACACTGTGGTATACCGATAATCCTCAAAACGCGTCGGAT
TATTTCATAAATATGTATAATAAAACTGTTACAATTGATACTAACTCAACCGCCAAAACTACCATCGACGATGTCAC
ACTATTAGGAAAATTTAACAATCACGAAAAATGGTGGGATGATCTTACAGAAGAATGCAGACTGATGCAATTGACAA
CAATGAGCGCGAAGATCCGTCTTACTGCGGAAATCGTGATGTATTTTGCGGCAGTGCTCTACATCTTGGCTGCGTTG
CGAGAAGCGAGATTTTTAGGTCTCAACATGTTCATTGAAAATCTCATGACGGCGCCGTCGCGCGTCATGTTTCTGTT
CTCGTGTTGCATCTTAATGTCGTTTCCGGTTCTGAGACTTTCCTGCTCCGATGAGGTCGAAGACGTGCTGGCAGTTG
TAGTGATGCTAACAACGGCGCCATATTTTTATTCTTCTGCCGAGGTTTCAAGACAGTCGGCCCGTTTGTCGTGATG
ATTTACAGAATGATTACGGGCGATCTCCTCAGATTCGTCTCTATCTATCTCGTCTTCGTGATGGGATTCTCTCAAGC
GTATTATATCATATTTTTGTCGTTTGACAATCCGAATACTCCGGAAGGCGTTGACGATTCGATAACAAATCCTATGC
CATCGCCGATGGAGAGCGTTATGGCAATGTTTCTGATGAGCATGACAAATTTCGGCGATTATTATGCCACGTTTGAC
AGAACCGAGCATGAATTCGAAGCCAAGCTGCTGTTCGTGTTATATATGGCGATCGTGGCAATCCTGCTCGTAAACAT
GTTGATTGCTATGATGGGCAACACTTACCAGAAGATCGCTGAAACCAGAAATGAGTGGCAGAGACAATGGGCGCGCA
TAGTCTTGGTTGTGGGAGAGGCCGTAAGTCCTGCTGAAAGATTAAAAAAATTGATGGACTATTCTCAGCCCATGTCT
GACGGTCGTAAAGCGTTGGTTCTCCGATTAAATCAAACTGAAGAAGACAAGGAAGAAATGAAAGAGATACTTGAAAT
GAAAAGGACGCACGATAAATTAATAAAGAAAAGACAAGACAAAATATTAAAGGAGAAAGCTTTAGCTGAAACAGAAG
CTGTTATTACTAGAAAATAA

FIGURE 28 - SEQ ID NO: 23

<> 23
<> 2014, partial
<> DNA
<> Myzus persicae
<> in-house
<> ?
CGCGATCAAAACACAAGTGGAACCCATGCTGTACAACAAGGGTGAAGGCAGAATGATACCGATTGCCAAACTCGTGT
TACTGAGAAATCGCGACCGTTCCCGGGCAAGATGGCTTCCACCGTTAAAGAACATGGAAGACGCCAATGAATACGAT
ATCGAAAAAGACATTCCCACCATCGAAGAACTGGAAAAGCTGGGGGAAGTGCAGTNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNTGGCAAGAGGAGCCGATCCAAATAACCAGGATACCAACGGCAATACAGTTCTGCA
CATGCTCGTAATTTACGAAAAAATCTCGACGTTCGACATGGCCTACGAAATCGGGGCGGAGCTCAACATTAGGAACG
TGCAAAATTTGACACCACTCACGCTGGCCGCGAAACTGGCTCGGATCCAAATGTTCTTTCACATACTCAAAATCGAA
CGGGAAATTTATTGGCAAATCGGCAGTATCACTTGTGCCGCGTACCCCCTGNNNNNNNNNNNNNNNNNNNNNNNNNN
NNNNNNNNNNNNNNNNNNNNNNNNNNNNNNNNNNNNNNNNNNNNNNNNNNNNNNNNNNNNNACACTTGGAGATGATGG
ACGGTGTGTTGGTGGATCTGCTAAATGCTAAATGGAACGCTTTCGTGAAATTCCGGTTCTATAGGCAGTTCATCTTG
TTCGCGTTTTACTTTTCCATATCCATGGTGTGCTTCGTTTTGCGTCCCGGGCCGCCACCCACTGGTCTTAAGCCGCC
ATTAATCAACTACACTTCGACGTCGACCACGGTGGCCACCACGCCGTTTGACTTCATGGACAACGAGTCGATGTTGC
CCGACAACGTCATGTACGACGAAATGATGATCGGCGGTGGCGGTCCGACCGAATTCGAAACGCCGGTGGTAACCACG
GAGATGGCGACGGTCAATGACAACGCCACAACCAACAACGGTACCGGTATCATCCGTACGCCACTGATCTACGAGGA
CGGTGCTGGAGGTGGTGGTGGAAGTGGTACCGTAAGCTTGCACGGTAAGAGTTCCGGTTCGGACAGGGGCAAACACA
GGAGCACGTGGAATCCCGCCAACCATACGTTCAAGACCAACTACACGTACAACTACAACAAATCGAGAAAATTTTGG
TGGAACAAGAGACAAAAGGTGTGCAGATTAATGGCAGTGCATTCGACTGATGATCTAATCAGAATGGGGTCGGAAGT
GGGAATGTTTGTGGGAGCCTTCCTCTATCTACTGGCCGCAGTCAGAGAAGCTGGATTTTTGGGCTCCCAGATGTTCA
TTGAAAACCTGGCCATAGCACCGGCAAGAGTGATGTTTCTGTTCTCGTGCCTGCTCATGATGACCATACCACCACTG
AGACTGACGTGCTATGACAAAGCCGAAGACATAATAGCCGTAATCATCATGTTGACCACTTGTCCGTACTTTTTGTT
CTTCTGCAGGGGTTNNNNNNNNNNNNNNNNNNNNTGGTGATGATCTACAGGTTGGTGATGGGAGACTTGCTGAGAT
TCGTTTCCATTTACATGGTGTTCGTGATGGGGTTCTCGCAAGCTTATTACGTGATTTTCCTATCTTACGACAACCCG
CTGACACCAGAGGGCATTGACGATTCCGTGCTGAACCCGATGCCCACGCCGACCGAGTCCATCATGGCGATGTTCCT
TATGTCCGTCAATACGTTCACAGATTACTACACGGCGTTCGACAAGACTAGTCACACGTTGGTCGCAAAGTTTTGCT
TTATAGTTTTCATGGTGATCGTGGCCATATTGCCGGTGAACATGTTAATCGCCATGATGGGGACACTTATCAAAAG
ATCGCCGAGACCAGAAACGAATGGCAGAGACAATGGGCTCGGATCGTACTGGTGGTAGAGAGAGGTGTCAGCCCGTC
ACAGAGGCTCAAAAAGCTCATGTACTACTCGCAACCGATGTCAGATGGTCGGAGGGCGTTGGTGTTGCGACTCAATC
AGACGGATGAAGACAAGGAGCAAATGAAAGAGATATTGGAAATGAAACGCATTCACAATCGCTATGTTGAAAGAATG
CGCGCAAGAGACCTGAGCAGCAAACTATCGTCTTCGTGCGGAAAAAATGCAAACGATGGGACAATTAATTTAAAAGC
AAATAAATA

FIGURE 29 - SEQ ID NO: 24

<> 24
<> 1661, partial
<> DNA
<> Bemisia tabaci
<> in-house
<> ?
GATCCTGAGAAAATTGATCCGAAGAAATGCCGAGAGGTATGCTGGGATTTGATGGAACGTGGAGCGGTGGGTGAAAC
TATTCTCCATCTGTGCCTCCTCAACGCCACATCCATCCATGCAGACTTGGCCAAGCGACTCCTCCGCTTTTATCCGA
AACTTATCAACGATATATACATGTGCGACGAATATTACGGTGAAAGTGTGCTACATATTGCCATAGTGAACGAAGAT
CCAGCGATGGTGAAGTTCCTTTTAGACAGTGGCGCTGACTACCACGAGCGTTGTACCGGGAACTTCATGTGTCCTGA
GGATCAGAAGGCTACAAGGCAGGACACAGTTGAGCATGAATGGGTGAATCTGTCGCCACTCACCAACTACGAGGGAT
ACGTGTACTGGGGTGAGTACCCACTTAGTTTTGCGGCTTGTCTGGGCCAAGAAGAGTGCTTCCGACTCATGCTCGCG
CGAGGAGCAAATCCCGATAATCAAGACACAAATGGAAATACCGTTCTTCATATGCTCGTCATCTATGAGAAACTCGA
AACATTTGACATGGCATACGAAGTTGGCGCCAACATTTCTGTTCGGAATGTCCAGAATTTGACTCCTCTCACTTTGG
CAGCAAAACTCGCGAGAATTGAGATGTTCTTCCACATTTTAAACATCGAACGCGAAATCTATTGGCAAATTGGCAGT
ATTGCATGTGCAGCTTATCCTCTAGGGCAAATCGACACAATTGACATCGAAACAGGACACATCAGCAAAAATTCGGC
TCTTAATCTTGTGGTCTTTGGGGACAAAGACGAACATCTGGAGTTGATGGATGGCGTTTTGGTGGACCTTTTGAACG
CCAAGTGGAACGCTTTTGTCAAATTGAGGNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNTGATAATGTTGCTTACGTCACCATACTTTCTCTTCTTTTGCCGGGGATTCAAGA
CGGTCGGACCATTCGTCGTTATGATCTACAGGATGGTCATGGGGATCTACTCCGATTCGTTTCCATCTACATGGTC
TTCGTCATGGGATTCTCTCAAGCCTACTACATCATATTTCTATCCTTCGACAACCCTAGTACACCAGACGGAGTGGA
CGACACGGTGAGCAATCCAATGCCAAACCCAGTTGAGGCTGGAATGGCCATGTTCCTCATGTCACTCAACACTTTCG
GTGACTATTTTAGCGCCTTTGAAAAAACCGAACACGAGCTAGAGGCTAAGGTATGCTTTGTAATATTCATGGGTATC
GTTGCCATTCTACTGGTTAACATGTTGATTGCTATGATGGGTAACACTTACCAAAAAATCGCAGAAACCCGGAATGA
GTGGCAGAGACAGTGGGCCAGAATTGTTTTGGTTGTTGAAAGAGGAGTCCCACCGAAAGAGCGGCTAACTAAACTCA
TGTGGTACTCACAACCTATGTCCGATGGCAGACGTGCGTTGGTCTTGCGCCTCAATCAGACGGAGCAAGACAAAGAG
GAGATGAAAGAGATTTTAGAGATGAAGCGAGTGCACAACCGAATCGTGGAGAAGCGGCAAAAGCGACTGGCAAAGCT
GTCCAACAATGCAAGCCCCTCTAACAAGCCTCTAGTTGACCTGCCAAACCTTTCGAACCATGATTCCCCTACAAAGC
CTCTCCTCGACCTTGCCAGTAACCTCAGCAAATTTTGA

FIGURE 30 - SEQ ID NO: 25

<> 25
<> 2428, partial
<> DNA
<> Euschistus heros
<> in-house
<> ?
CTCAGGTTCTACCCCAAGCTCATCAATGACGTCTACATGTCCGATGAATACTATGGTGAAAGTGTCCTGCATATTGC
CATAGTCAACGAAGATCCTGCGATGGTGAAATTCCTACTAGACAGCGGTGTCAATGTCAATGAACGCTGTTTTGGCA
ACTTTATGTGTCCTGAGGACCAGAAGGCATCGAGGACTGATTCACTCGATCATGAATGGGTCAACTTGCAATCATTT
ACTACTTATGAGGGGTATGTATATTGGGGTGAGTACCCACTATCCTTTGCGGCCTGCCTTGGACAGGAAGAAYGCTA
CAGATTGATGCTTGCACGAGGAGCTAATCCTGACAATCAGGATACCAACGGAAATACCGTTCTTCATATGCTAGTCA
TATACTGTAAAATACAAACTTTCGACATGGCCTATGAAGTTGGTGGAGACCTATCAATAAGAAATGTCCAATATCTA
ACACCATTGACATTGGCAGCTAAATTAGCTAGGATTGAACTATTCTTCCACATATTAAATATTGAAAGAGAAATATA
CTGGCAGATTGGCAGCATAACTTGTGCAGCTTACCCACTTTCACAAATCGATACTATTGATATTGTGACTGGAAACA
TCAGCAAAAATTCTGCTTTAAATCTTGTCGTTTTTGGCGAAAAGGATGAACATTTGGAACTTATGGATGGTGTCCTG
ATCGACCTTTTAAACGCAAAATGGAATGCCTTTGTAAAATTTAGGTTTTATAGACAGTTTTTCTTATTTCTCTTTTA
CTTCTTGATTTCGCTTATTTGTTTCACTCTACGACCTGGACCTCCACCAGTTAAACCAATATCAAGTTTCAACAGTA
CCAAACCCAGCGGAAATAACATTACTGCTGAATTGTCGCCAGAAAGCAATGCAACTACTGTTCCAAAATGGATTTAC
AAAACAGAAATTAAAAAGTATGATCCCGAAGACAACAGTAGTCAAAACAGCAGACTTAATGTAATATTACGTGAAGT
CATTTTGACATCTTTGAAAGTTGAAGATATTGATAAAGTAGTTTCTTTTTCAAATGCAGAGCCGCAAGACAATTCCA
GGGAAGATGCAGATGGATTGGTTTGCAATGGCGATTCTGTTCATTCCTGTTTAGGAAATGGATCTGATGTTGTTGCT
GTATTTGGAAAAGGCAAGAGCCCAAAAGTACCAAAACCTGGAGCCTCCGCCGATGATTTTGATTATGACGACACTTG
GTGGGAAGAATTTGGACAATGCAGATTACTTCAGGTCACTTCCTACATTGAAATGACCCGCCTTATATCAGAAGTCT
TGTTGGACATCGGAGCTTTGCTATACATATTAGCAGCATTGAGAGAAGCGAGATTTCTAGGATGGAGCATGTTTGTG
GAGAATTTGATGACTGCTCCTTCAAGAGTTATGTTTTTGTTTTCATGCTGTTTGATGCTAACGATGCCATTTTTAAG
ATTTACCTGCAATGAAGAAATAGAAGACATGATGGCAGTTATTATAATGCTCACCACTGCTCCTTATTTTCTGTTTT
TCTGCAGAGGTTTCAAGACCGTTGGTCCATTTGTTGTGATGATATATAGGATGATAATGGGAGACTTGTTGAGATTT
GCTACAATATATCTTGTCTTTGTGATGGGGTTTGCTCAAGCATATTATATCATTTTCCTGTCATTTGATAACCCACT
GACACCCGAAGGAGTGGATGATTCTGTAAGTAATCCTATTCCGAACCCAATGGAAGCAGTCATGGCAATGTTTTTTA
TGTCAATGACAAGTTTTGGCGATTACTATCCAGCTTTAGAAAGGACAGCTCATGAATTCTGTGCTAAGCTTTGTTTT
GTGATATACATGGCAATAGTAGCAATTCTACTGGTTAATATGTTAATTGCTATGATGGGAAATACTTATCAAAAAAT
AGCTGAAACAAGAAATGAATGGCAGAGACAGTGGGCCAGAATAGTATTAGTGGTTGAAAGAGGAGTAAGTCCATCAG
AGAGGTTAACTAAACTAATGTGGTACTCACAGCCTATGTCAGATGGAAGAAGAGCGCTGGTACTGAGGCTAAACCAA
TCGGAGGAAGATAAAGAGGAAATGAAAGAAATTCTAGAGATGAAAAGAATTCACAACAGAATGGTACAAAAAAGGAA
AGAAAGGGAAAGTCGATGAACAAAAGCCCAAATTTGATCAATTTAAACAGTCCGGCTGAAAATGTTAAAAATACAA
ATCCTTTCAGTTAATTCAGTTAACAGAACAAAGTGAATTAAACACAACAGAATAATCTTCTTATGAAACTATGATAT
CAGCCCCTGAAGTCTTTGTATCAAATCAAGCACCCTGTGAGCAGATGGGCAATAAACAAAAAATATGTTTTCTATGG
ACTAGCCCCAAAATAGATCTATTGATTTCAATGAAACTTGC

FIGURE 31 - SEQ ID NO: 26

```
<> 26
<> 2205, partial
<> DNA
<> Nilaparvata lugens
<> in-house
<> ?
CTGCATATGGCCATTGTGAATGAGGACCCAGGCATGGTGAAGTTCCTGCTGAACTCGGGAGCCGACTTCCACGAACG
CTGCTTCGGCAACTTCATGTGTCCCGAGGACCAGAAGGCATCCCGCTCCGATTCCTTCGATCACGAATGGGTCAATC
TCTGGCCTGTCACCAACTACGAGGGTTATGTGTACTGGGGCGAATACCCGCTATCTTTTGCTGCGTGTTTGGGTCAG
GAGGAATGCTATCGGCTCATGCTAGCCAGGGGGGCCAACCCCGACAACCAGGACACTAATGGCAACACTGTTCTTCA
CATGCTTGTCATATACGAGAAAATGGGAACGTTTGACACAGCTTACGAGCTGGGTGCCAACGTATCGGTGAGGAACA
TTCAGAACTTGACACCTCTGACACTGGCAGCCAAGCTGGCCAGAATTGAAATGTTCTTCCACATAATGAACATCGAA
CGAGAAATTTACTGGCAAATTGGTAGTATTACTTGTGCGGCCTATCCCTTGATGCTRATCGATACAATAGATATTGA
AACAGGGRATATTAGCAAAGATTCGGCTCTCAATCTTGTCGTATTTGGGGACAAAGATGAGCATTTGGATTTGATGG
AAGGCGTGCTGGTAGATTTGCTCCATGCCAAATGGAATGCATTTGTCAAGTTCAGGTTTTACCGCCAGTTCATAATG
TTCTTCCAGTACTTTCTGATATCGTGCGTGTGCTTCATACTGCGGCCTGGTCCCCCCGAAGCGCACGACGGTATGAA
CATCACCGCCAATGCTACACTCAACCTGAGCTTCGGGGTGCTYGAAGTCCGACCTGARCGTTGCAAGCGYTGCTCT
AYMGGCTCGAGAAGCTGTCACTGCCCCAGTCGGGTGATCTGGAAAGGTTCATTCTGGAATCTCTRGCTGATGAGAAG
TCAATTTCAGAAGCTGCATTAGAGAACGATGAGAATCGGGRACCAGGCTGGAACAATAGTGTRTTTTCAACGTATGA
AACGCTGGCTCGTGATACGGGCTACCAAACTGATGAGAGTCCRCATGACGGATTGTCGAGTAGTATGGATTAYGCCG
AGGTGGCCGAGCGATTGACCAAACTGATGATTGATGTCAAYCTGACTGAGAGGAGTGGAGCTGTCAATGAGATTATA
CTGAAAGCTTTGCCTAGTCTTGAGGAGAAAGAGGATGGTTTGGAGGAGTGGTGGAGCGGAATAGCCGGTGACTGTAT
CCTGTTGCAGGTGAATGACCTCTACGACTTGGCACGCCTGTGCGCCGAGGTGGCGCTTGAAATTGGCGCCTTTCTCT
ACCTGCTGGCAGCACTGCGCGAGGCCCGCTTCCTCGGACTCAAAATGATGATCGAGAATCTGATGACGGCGCCGTCG
CGTGTGATGTTCCTGTTCTCATGCTGCCTGATGATGACGATGCCCTTCTTCCGCTTCACCTGCCAGGACGAGACCGA
GGACATCCTGGCCGTTGTCATCATGCTCACAACGGGGCCTTACTTCCTCTTCTTTTGCAGAGGGTTCAAAACAGTGG
GACCTTTCGTAGTGATGATTTACAGAATGGTAATGGGTGATCTTCTGAGATTCGTGTCTATTTACATGGTGTTTGTG
ATGGGATTTTCACAAGCGTATTACATAATTTTCTTGACGTACGACAACCCGACTACACCAGAAGGTACGGACGACAC
TACGTCGAATCCACTGCCCAGTCCAATTGAAGCCATTATGGCCATGTTCTTCATGTCACTCACCAACTTTGGAGATT
ACTACTCTGCGTTCGAGAACACTGAACATGAAATCGAAGCTAAGGCTTTCTTTGTGATTTACATGGTGATTGTGGCG
ATTCTTCTAATCAACATGTTGATCGCTATGATGGGTAACACTTACCAGAAGATTGCTGAAACAAAGAACGAATGGCA
AAGACAATGGGCCAGAATAGTTCTGGTTGTGGAGAGAGGTGTTAGTCCTAAGGAACGCTTGAAAAAGCTCATGTCCT
ATTCACAGCCTATGTCCGATGGAGGGAGGGCTCTGGTTCTCAGGCTGAACATGACGGAAGAAGACAAGGAAGAAATG
AAAGAAATCCTGGAAATGAAACGTGTACGTGATAAAATTGTCATGAAGCGCAAAAAAGGCTTGAAATTGTTGGGGAC
TACAACTCCTAGTCCAAAGAGGATGAAAGGCCGAGAAACTCCTATTTAA
```

FIGURE 32 - SEQ ID NO: 27

<> 27
<> 487, partial
<> DNA
<> schistocerca americana
<> in-house
<> ?
CTGCATATGGCCATTGTGAATGAGGACCCGGCCATGGTGAAGTTCCTGCTGGACAGTGGTGCCAACGTGCACGAGCG
CTGCTTCGGCACGTTCATGAGCCCGGAGGATCAGAAGGCCCAGCGCTCAGACTCCCTGGACCACGAGTGGGTCAACG
TCAACTCGGACACAAACTATGAAGGCTACGTGTACTGGGGGGAATACCCGCTGAGCTTCGCTGCCTGCCTGGGACAG
GAGGAGTGCTATCGGCTGGTGCTCGCCAAGGGTGCCAACCCAGATAGCCAAGACACCAACGGAAACACGACACTGCA
CATGCTCGTCATCCACAGGAAGATGACCCAGTTCGACATGGCTTATGAAGTTGGCTCTTCACTCGACATTAAGAATA
ACCTCAACCTCACACCTCTCACGTTAGCCGCTAAGCTGGCACGAATAGAGATGTTTTTCCATATCTTAAACATAGAA
AGAGAGATCTACTGGCAAATAGGTT

FIGURE 33 - SEQ ID NO: 54

<> 54
<> 833
<> PRT
<> Drosophila melanogaster
<> NP_648696.2
<> ?
>gi|45550616|ref|NP_648696.2| nanchung, isoform A [Drosophila melanogaster
MGNTESNVTSGVKKQAGVSTQALYKFVNLKGGGLLVDMMKRACQTKQFAEIDHAIKTKVEPFLYNKGAGRYFPISKL
VLLRNRDRPRTRQLPEIRALENPDDDFNIHDYCPEVSEAEYISNPTAYRFVCWDLNMRGAVGETILHLCLLNASSLH
ADLAKRLLKFYPKLILDIYMSDEYYGESVLHIAIVNEDPAMVKYLLDANADVQERCCGAFMSAEDTKFSRTDSPDHE
YVALCPMTNYDGYVYWGEYPLSFAACLSQEECFRLVLARGADPDFQDTNGNTVLHMLVIYEKIEMFDVGYEVGTNIH
IKNIQNLTPLTLAAKLGRVEMFFHVMSIEREIYWQLGSITCAAYPLLMIDTINEETGNINKDSVLNFVVFGDKLEHL
ELLDGVVIDLLKTKWDTFCKSRFYKQFYMFALYFLISLFSFILRPGPDAKDEDEDGANSTTAKSDLYRQNGSDSYHL
HSKRATMTTEYKTFWLNFTEYYDPSEVEVLPAWWESYAQCPLMNLESDLAKLRIMAELLNFVGAILYLLVALREARF
LGLKMFIENLMTAPSRVMFLFSCALMMTIPWLRVSCLTEIDDHVTVVIMLTTAPYFLFFCRGFKTVGPFVVMIYRMV
MGDLLRFVSIYLVFVMGFSQAFYIIFLTFDNPSSPEDQDAESNPMPSPMESIVAMFLMSLTNFGDYYGAMVSTQHEY
EAKILFFLFMVIVSVLLVNMLIAMMGNTYQKIAEIRNEWQRQWARIVLVVERSVPPAERLKNFMQYSQSMSDGRRAL
VLRLNMTEEKEEMKEVQEMKRIHQRFAKKRQMEREARALRRQQEYEKFFGTAPKSECSDNNNF

FIGURE 34 - SEQ ID NO: 55

<> 55
<> 834
<> PRT
<> Drosophila melanogaster
<> NP_001261833.1
<> ?
]>gi|442632275|ref|NP_001261833.1| nanchung, isoform B [Drosophila
melanogaster]
MGNTESNVTSGVKKQAGVSTQALYKFVNLKGGGLLVDMMKRACQTKQFAEIDHAIKTKVEPFLYNKGAGRYFPISKL
VLLRNRDRPRTRQLPEIRALENPDDDFNIHDYCPEVSEAEYISNPTAYRFVCWDLNMRGAVGETILHLCLLNASSLH
ADLAKRLLKFYPKLILDIYMSDEYYGESVLHIAIVNEDPAMVKYLLDANADVQERCCGAFMSAEDTKFSRTDSPDHE
YVALCPMTNYDGYVYWGEYPLSFAACLSQEECFRLVLARGADPDFQDTNGNTVLHMLVIYEKIEMFDVGYEVGTNIH
IKNIQNLTPLTLAAKLGRVEMFFHVMSIEREIYWQLGSITCAAYPLLMIDTINEETGNINKDSVLNFVVFGDKLEHL
ELLDGVVIDLLKTKWDTFCKSRFYKQFYMFALYFLISLFSFILRPGPDAKDEDEDGANSTTAKSDLYRQNGSDSYHL
HSKRATMTTEYKTFWLNFTEYYDPSEVEVLPAWWESYAQCPLMNLESDLAKLRIMAELLNFVGAILYLLVALREARF
LGLKMFIENLMTAPSRVMFLFSCALMMTIPWLRVSCLTEIDDHVTVVIMLTTAPYFLFFCRGFKTVGPFVVMIYRMV
MGDLLRFVSIYLVFVMGFSQAFYIIFLTFDNPSSPEDQDAESNPMPSPMESIVAMFLMSLTNFGDYYGAMVSTQHEY
EAKILFFLFMVIVSVLLVNMLIAMMGNTYQKIAEIRNEWQRQWARIVLVVERSVPPAERLKNFMQYSQSMSDGRRAL
VLRLNMTEEEKEEMKEVQEMKRIHQRFAKKRQMEREARALRRQQEYEKFFGTAPKSECSDNNNF

FIGURE 35 - SEQ ID NO: 56

<> 56
<> 838
<> PRT
<> Musca domestica
<> XP_005180489.1
<> ?
>gi|557761542|ref|XP_005180489.1| PREDICTED: transient receptor potential
cation channel subfamily V member 5-like [Musca domestica]
MGNTESNVTSGVKKQAGVSTQALYKFVNLKGGGLLVDMMKRACQTKQFAEIDHAIKTKVEPFLYNKGAGRYFPISKM
VLLRNKERARTKQLPEIRALENPDEDFNIHDYCSEVSEAEYISNPSAYRFVCWNLNERGAVGETILHLCLLNASSLH
ADLAKRLLKFYPKLIMDIYLSDEYYGESVLHIAIVNEDPAMVKYLLDANADVQERCCGAFMSAEDQKASRYDSPEHE
YVGVHPMTNYDGYVYWGEYPLSFAACLSQEECFRLVLARGADPDSQDTNGNTVLHMLVIYEKIDMFDVAYEVGTNIH
IRNVQNLTPLTLAAKLARVEMFFHILSIEREIYWQLGSITCAAYPLSKIDTIDVKTGNINKDSVLNFVVFGDKLEHL
ELLDGVVIDLLKTKWETFVKSRFYKQFYMFSFYFLFSLVSFISRPGPKIEDEDEEGDANDSAGKGNDSTTNARLLYA
TPASRVTGIEKLPYKTFWLNFSEYIDDDANAENMPSWWASYEECPLMDMETNLAKFRIVSEIVIFFGAILYLLSALR
EAKFLGYKMFVENLMTAPSRVMFLFSCCLMMTIPWLRLSCLTELDDHVAVMIMLTTAPYFLFFCRGFKTVGPFVVMI
YRMVMGDLIRFVSIYLVFVMGFSQAYYIIFLTFDNPATPEEIDDTGTNPMPSPMESVVAMFLMSLTNFGDYYGAMGS
TQHEYEAKILFFLFMVIVSVLLVNMLIAMMGNTYQKIAEIRNEWQRQWARIVLVVERSVPPAERLKNFMQYSQPMSD
GRRALVLRLNMSDEDKEEMKEVQEMKRIHQRFSKKRQMEREARAKKRQEEYEKFFGATPTSDNENNNF

FIGURE 36 - SEQ ID NO: 57

<> 57
<> 844
<> PRT
<> Ceratitis capitata
<> XP_004537742.1
<> ?
>gi|499014264|ref|XP_004537742.1| PREDICTED: transient receptor potential
cation channel subfamily V member 5-like [Ceratitis capitata]
MGNTESNVTSGVKKQAGVSTQALYKFVNLKGGGLLVDMMKRACQTKQFAEIDHAIKTKVEPFLYNKGAGRYFPISKL
VLLRNKERARTKQLPEIRAMENPDEDFNIHDHCTEVSEAEYISNPSAYRYVCWNLNERGAVGETILHLCLLNASSLH
ADLAKRLLKFYPKLILDVYMCDEYYGESVLHIAIVNEDPAMVKYLLDAGADVQERCCGAFMSAEDQKASRYDSPDHE
YVGVQPMTNYDGYVYWGEYPMSFAACLSQEDCFRLVLARGADPNLQDTNGNTSLHMLVIYEKIEMFDVAYEVGTNIH
LRNVQNLTALTLAAKLGRVEMFFHILSIEREIYWQLGSITCAAYPLSMIDTIDVETGNINKDSVLNFVVFGDKLEHL
ELLDGVVIDLLKTKWESFVKSRFYKQFYMFSFYFLFSLISFISRPGPTEKNEDDDDDDADASVEATVTRAANSTAP
LQRGDQWFKRLIKRAIDKMEYKTFWLNFTDYFDDNDVESVPPWWASYAECPLMNMESDLAKLRIVAEIIIFFGSVLY
LFAALREARFLGYKMFVENMMTAPSRVMFLFSCALMMSIPWLRVFCLTEIDDHVAVFIMLTTAPYFLFFCRGFKTVG
PFVVMIYRMVMGDLIRFVSIYLVFVMGFSQAYYIIFLTFDNPATPEEIDDSESNPMPSPMESIVAMFLMSLTNFGDY
FGGMASTQHEYEAKTLFFLFMVIVSVLLVNMLIAMMGNTYQKIAEIRNEWQRQWARIVLVVERSVPPAERLKNFMHY
SQPMSDGRRALVLRLNMSDEVKEEMKEVQETKRIHQRFSKKRQIEREARAQKRQEEYEKFFGKKPSGNSDNNNA

FIGURE 37 - SEQ ID NO: 58

```
<> 58
<> 833
<> PRT
<> Anopheles gambiae
<> XP_320300.4
<> ?
```

>gi|158300356|ref|XP_320300.4| AGAP012241-PA [Anopheles gambiae str. PEST]
MGNTESNVTSGVKKQAGVSTQALYKFVNLKGGGLLVDMMKRAIQNKQYAEIDHAIKTKVEPFLYNKGKGKYIPVSVL
VLLRNRERPRHKQLPEIRAMENPEEDFDIDAVCPEVSEAEYYLNPSGYREVCWNIKERGAVGETILHLCLLNATSLH
ADLAKRLLRFYPKLINDVYMCDEYYGENVLHLAIVNEDPAMVKYLLDHNADVNERCCGTFMCPEDQKASRYDTPETE
VVQMVQVTNYDGYVYWGEYPLTFAACLGQEECYRLVLARGADPDNKDFNGNTVLHMLVIYEKIATFDMGYEVGSSLS
IRNHQNLTPLTLAAKLGRVEMFFHIMNIEREIYWQLGSITCAAYPLGLIDTIDVETGNINKDSALNLVAFGDKDEHL
DLLDGVLIDLLKTKWNTFVKDKFYRQFFMFFCYFCVSLVSFTLRNGPPPAEDDDGKESEAGGNKTAAVTKEELRRQL
WNETTLEDALAALAGNGSFAGRLSNLEQSNGSSDAMGEFDPAEMDDEGLFFNSNCHTMDYDGVEGKVRLISEMIILV
GSFLYLLAALRELKFLGRKMFFENLMTAPSRVMFLFSCCIMMIVPFLKVLCFTELEDHVAVTIMLTTAPYFLFFCRG
FKTVGPFVVMIYRMVMGDLLRFVVIYLVFVMGFSQAYYIVFLSYKPDEEGDPNPMPSPIESIVAMFLMSLTNFGDYY
GALENTDHEMCAKILFVLFMVIVAVLLVNMLIAMMGNTYQKIAETKNEWQRQWARIVLVVERGVPPKERLKNLMSYS
QPMSDGRRALVLRLNMTEDKEEMKEILEMKRVHERLSIKRQIERDARAEQRRLLREKYLNMSS

FIGURE 38 - SEQ ID NO: 59

```
<> 59
<> 815
<> PRT
<> Aedes aegypti
<> XP_001652424.1
<> ?
```

>gi|157114792|ref|XP_001652424.1| hypothetical protein AaeL_AAEL001123 [Aedes aegypti]
MGNTESNVTSGVKKQAGVSTQALYKFVNLKGGGLLVDMMKRAIQNKQYAEIDHAIKTKVEPFLYNKGKGKYIPVAQL
VLLRNRERPRSKQLPEIRALENPEEDFDIDAVCPDVTEGEYQRNPSGYREVCWNIKERGAVGETILHLCLLNATSLH
ADLAKRLLRFYPKLINDIYMCDEYYGESVLHVAIVNEDPAMVKYLLDSGSDVDERCCGTFMCPEDQKATRYDSIETE
IICVLPMTNYDGYVYWGEYPLSFAACLGQEECYRLVLARGADPDNQDSNGNTVLHMLVIYEKISTFDMAYEVGSSLD
IRNLQNLTPLTLAAKLGRVEMFFHIMNIEREIYWQLGAITCAAYPLALIDTIDIETGNINKDSALNLVVFGDKAEHL
DLLEGVLIDLLKTKWNSFVKDKFYRQFFVFFWYFCVSLVSFTLRRGPMNLEETAANRTTTSITLKNLTFSDSTNATL
PTLLAADVNEKIVQFIANETLFDPAVMEENTFFNSKCATMAYDTLQDKIRLVSEIIILIGSFLYLVGALREFRFLGR
KMFFENLMISPSRVMFLFSCCIMMIVPFLKVLCLIELEDHVAVTIMLTTAPYFLFFCRGFKTVGPFVVMIYRMVMGD
LLRFVVIYLVFVMGFSQAYYIVFLSFKGEEEGDENPMPSPMESIVAMFLMSLTNFGDYYGALEKTEHEGCAKVLFVI
FMVIVAVLLVNLLIAMMGNTYTMIAETKNEWQRQWARIVLVVERGVPPSERLKNFMSYSQPMSDGRRALVLRLHMTD
EDKEEMKEILEMKRVHERLKKKRQVERELRAEQRRLIMEKYANVP

FIGURE 39 - SEQ ID NO: 60

<> 60
<> 816
<> PRT
<> Culex quinquefasciatus
<> XP_001847136.1
<> ?
>gi|170038599|ref|XP_001847136.1| TRP channel protein nanchung [Culex quinquefasciatus]
MGNTESNVTSGVKKQAGVSTQALYKFVNLKGGGLLVDMMKRAIQNKQYAEIDHAIKTKVEPFLYNKGKGKYIPVAQL
VYLRNRERPRHKQLPEIRALENPEEDYDIDKECPDVTEGEYMRNPGGYREVCWNIKERGAVGETILHLCLLNATSLH
ADLAKRLLRFYPKLINDVYMCDEYYGESVLHLAIVNEDPAMVKYLLDAGSDVNERCCGTFMCPEDQKASRFDSLETE
IICVMPQTNYDGYVYWGEYPLSFAACLGQEECYRLVLARGADPDNQDSNMNNVLHMMVIYEKLTTFDMAYEVGSSLS
IRNLQNLTPLTLAAKLGRVEMFFHIMNIEREIYWQLGSITCAAYPLALLDTIDIETGNISKDSALNLVVFGDKDEHL
DLLEGVLIDLLKTKWNTFVKDKFYSQFFVFFCYFCVSLISFTLREGPMKLEDGEANKTTTSIQLKNMTLADLTNAST
LSSLLVTDVSGKIVGLNGSETFFDPSTIESDMFFNSKCPTMIYKGIEGKIRLVSEAIILVGSFLYLVSALRESRFLG
RKMFIENLMTAPSRVMFLFSCCIMMVVPCLKVLCFTELEDHVAVVIMLTTAPYFLFFCRGFKTVGPFVVMIYRMVMG
DLLRFVAIYSVFVMGFSQAYYIAFLSYKGEEEGDENPMPSPMESIVAMFLMSLTNFGDYYAALEDTAHEGCAKVLFV
TYMVIVAVLLVNLLIAMMGNTYTKIAETKNEWQRQWARIVLVVERGVPPAERLKNLMNYSQPMSDGRRALVLRLNMT
EEDKEEMKEILDMKRVHERLSKKRAVEREARAEQRRLIAEKYANVP

FIGURE 40 - SEQ ID NO: 61

<> 61
<> 794
<> PRT
<> Tribolium castaneum
<> XP_967896.1
<> ?
>gi|91081969|ref|XP_967896.1| PREDICTED: similar to nanchung CG5842-PA [Tribolium castaneum]
MGNTESNVTSGVKKQAGASVQPIYKLCDLKGGGLLVELMKRATQNKQYAELDHAIKTKVEHFLYNKGAGRYFTISDL
VLLRNKERSRQKWLPQLKAMENPEDFEIDDEGPEITEEQYQKNPHLYRHVCWKIKERGAVGESIMHLCLLNATSLHA
DIAKRLLRFYPKLINDIYMSDEYYGENVLHIAIVNEDPSMVKFLLDSGVNIQERCCGNFMCPEDQKSSRYDSLDHEW
VNVCPVTNYEGYVYWGEYPLTFAACLGQEESFRLMLSRGADPDAQDTNGNTVLHLLVILQKLEAFDMAYEVGAKLSI
RNVLSLTPLTLAAKLARIDMFFHILNLEREIYWQIGSITCAAYPLSQIDTIDIETGQISKTSALNLVVFGDKDEHLE
LMDGVLIDLLNAKWNTFVKFKFYKQFFTFAFYFLISLVAFTLRPGPPHKEAKLVNVTINATVSNTSKWENLTSIPFG
KTPDDDDSDMEEWWDNLQEECRLMQLESPESKIRLTAEVLMVVGAFAYLAAAVREARFLGGRMFFENLMTAPSRVMF
LFSCILMLTVPCLRLACLDEFEDIVAVVIMLTTAPYFLFFCRGFKTVGPFVVMIYRMVMGDLIRFASIYLVFVMGFS
QAFYIIFLSFDNPLTPDDVDDSATNPISTPIESIMAMFLMSMTNFGDYYAAFEKTDHEYEAKMLFVVFMVIVSILLI
NMLIAMMGNTYQKIAETRNEWQRQWARIVLVVERGVSPSERLKQLMVYSQPMSDGRRALVLRLNQSDEDKEEMKEIL
EMRRRHERHIKKRSEKLKENAKKN

FIGURE 41 - SEQ ID NO: 62

<> 62
<> 841
<> PRT
<> Bombyx mori
<> XP_004923070.1
<> ?
>gi|512892991|ref|XP_004923070.1| PREDICTED: transient receptor potential
cation channel subfamily V member 5-like [Bombyx mori]
MGNTESNVTSGVKKQAGTSEQKLYKLVDIKGGGLLVDMMKRALQNKQYAEIDHAIKTKVEPFLYNRGRGRYIPISHL
VLLRNKERPRHKLLPPLRGMENPDEEFDVDKDWPVVTQEEYDANPSGYRELCWDVKERGAVGETILHLCLLNATSLL
AHLAKRLLRFYPKMINDIYISDEYYGETVLHITIVNEDPTMAKFLLDAGADYHERCYGNFMCPEDQKASRTDSFDHE
WVNVQPDTNYNGYVYWGEYPLSFAACLGQEECYRLILARGADPDKQDTNGNTVLHMLVIYEKMSTFDMAYEVGASLN
IRNVQNLTPLTLAAKLARTEMFFHILNIEREIYWQIGATTCAAYPLGQVDTIDTETGLISKDSALNLVVFGEKDEHL
GLLEGMLIDLLKTKWNTFVKFRFYRQFILFSCYFLVSLICFTLRPGPPPDRALNTTVLNSTIGPNVTDAELVSDVENC
TMTPNADFDTNAVEVLNGTKFGGSHCARFKSHPKEKSTEAPRENDVEGWWEDLTEECRLMNLDTWQAKLRISAELLL
WMGALAYFGAALREAKFLGIKMFIENLSTVPSRVMFLFSCLLMLILPTLRLWCADEAEDHLAVMIMLTTAPYFLFFC
RGFKTVGPFVVMIYRMVMGDLLRFVCIYLVFVMGFSQAYYVIFLSFDNPNTPEGVDDSVSNPMPSPMESIMAMFLMS
LTSFSDYYTAFDRTDHEIEAKLLFVIYMIIVAILLVNMLIAMMGNTYQKIAETRNEWQRQWARIVLVVERGVPPAQR
LKQLMTYSQPMANGKRALVLRINQKDEDKEEMKEILEMKRTHERIVAKRKQREALKPGEIPPPARDYPIRK

FIGURE 42 - SEQ ID NO: 63

<> 63
<> 792
<> PRT
<> Anopheles darlingi
<> EFR23411.1
<> ?
>gi|312376272|gb|EFR23411.1| hypothetical protein AND_12928 [Anopheles
darlingi]
MGNTESNVTSGVKKQAGVSTQALYKFVNLKGGGLLVDMMKRAIQNKQYAEIDHAIKTKVEPFLYNKGKGKYIPVSVL
VLLRNSERPRHKQLPEIRALENPEEDFDIDAVCPEVSEAEYYLNPSGYREVCWNVKERGAVGETILHLCLLNATSLH
ADLAKRLLRFYPKLINDVYMCDEYYGESVLHLAIVNEDPAMVKYLLDHNSDVNERCCGTFMCPEDQKASRYDTPETE
VVQMVQLTNYDGYVYWGEYPLTFAACLGQEECYRLVLARGADPDNKDFNGNTVLHMLVIYEKITTFDMGYEVGSSLS
IRNHQNLTPLTLAAKLGRVEMFFHIMNIEREIYWQLGSITCAAYPLVLIDTIDVETGNISKDSALNLVVFGDKDEHL
DLLDGVLIDLLKTKWNTFVKDKFYRQFFMFFCYFCVSLIGFTLRNGPPPPEEDDENRAGGGSGNKTSSASKQDLRQR
LWNRTVTLEDADNVSSLLSDIMGIDALGKLAEQLLNGSEGSGAFKPETVEEEEDGLFFNSKCHTMDYDGVEGKVRFV
AEVIILIGSFLYLLSALRELKFLGRKMFFENLVSRGFKTVGPFVVMIYRMVMGDLLRFVVIYLVFVMGFSQAYYIVF
LSYKPEEDGDANPMPSPIESIVAMFLMSLTNFGDYYGALENTDHEMCAKILFVLFMVIVAVLLVNMLIAMMGNTYQK
IAETKNEWQRQWARIVLVVERGVPPKERLKNLMSYSQPMSDGRRALVLRLNMTDEDKEEMKEILEMKRVHERLSKKR
QVERDARAEQRRLLREKYLNMT

FIGURE 43 - SEQ ID NO: 64

<> 64
<> 900
<> PRT
<> Acyrthosiphon pisum
<> XP_001947907.2
<> ?
>gi|328706726|ref|XP_001947907.2| PREDICTED: transient receptor potential
cation channel subfamily V member 6-like [Acyrthosiphon pisum]
MGNTESNVASGVKKQVDTSSLQIYNLVDLKGCGLLVDLMKKAVQTKNFTELDNAIKTQVEPMLYNKGEGRMIPIAKL
VLLRNRDRSRARWLPPLKNMEDTNDYDIEKDIPTIEELEKLGEVQYREVCWDLKERGTVGETALHLCLLNATSIHAD
LAKRLLHFYPKLVNDIYMIDEYYGESVLHMAIVNEDPAMVKVLMDSGANLNERCFGNFMSTEDQKASRSDSLDHEWV
NLCPDTNYEGYVYWGEYPLSFAACLGQEESYRLMLARGADPNNQDTNGNTVLHMLVIYEKISTFDMAYEIGAELNIR
NVQNLTPLTLAAKLARIQMFFHILKIEREIYWQIGSITCAAYPLTQIDTIDNDTGQISRNSALNLVVFGESPEHLEM
MDGVLVDLLNAKWNAFVKFRFYRQFILFAFYFSISMVCFVLRPGPPPTGLKPPLINYTSTSTTVATTPFDFMDNESM
LPDMYDEMMIGGGGPTEFETVQVTTEMATTSDNATTTNNGSGIGTPLIYEDGGGGGGGGTVSLHGKSSGSDRGKHR
STWSPANHTFKTNYTYNYNKSRKFWWNKRQKVCRLMAVHSTDDLIRMGSEVGMFMGAFLYLLAAVREAGFLGTQMFI
ENLAIAPARVMFLFSCLLMMTIPPLRLTCYDKAEDIIAVIIMLTTCPYFLFFCRGFKTVGPFVVMIYRMVMGDLLRF
VSIYMVFVMGFSQAYYVIFLSYDNPLTPEGIDDSVLNPMPTPTESIMAMFLMSVNTFTDYYTAFDKTSHTLVAKFCF
IVFMVIVAILLVNMLIAMMGNTYQKIAETRNEWQRQWARIVLVVERGVSPSQRLIKLMYYSQPMSDGRRALVLRLNQ
TDEDKEQMKEILEMKRIHNRYVERMRARDLSSKLSSSCGKNANNGTFNLKANE

FIGURE 44 - SEQ ID NO: 65

<> 65
<> 707
<> PRT
<> Dendroctonus ponderosae
<> ERL84850.1
<> ?
>gi|546673192|gb|ERL84850.1| hypothetical protein D910_02274 [Dendroctonus
ponderosae]
MGNTESNVTSGVKKQAGAAMQPIYKLCDLKGGGLLVELMKRAAQNKQYAEIDHAIKTKVEHFLYNKGAGRYIPISQM
VLLRNKERGKHKLLPQLRGMENPEDFEVDDEGPEITEEEYNKDPSLYRHVCWKLRERGAVGETILHLCLLNATSLHA
DIAKRLLRFYPKLINDIYISDEYYGENVLHIAIVNEDPSMVKFLLAANVNFQERCFGNFMCPEDQKSSRTDSLDHEW
VNVYHETNYDGYVYWGEYPLSFAACLGQEESFRLILAKGANLDAQDTNGNTVLHLLVIYSKVEAFDMAYELGAHLSI
RNILKMTPLTLAAKLARMDIFFHILKLEREIYWQIGSITCAAYPLSQIDTIDVKTGQISKMSALNLVVFGDKDEHLE
LLDGVLVDLLNAKWNTFVKSKFYRQFFTFAFYFTVSLVDTSNDDYDVEEWWDNLREECRLMNLDTTESLVRFTAELG
ITFGAFLYLAAAMTAPSRVMFLFSCILVFGVIPSLRLVCMDEVEDIIAVVVMLTTAPYFLFFCRGFKTVGPFVVMIY
RMVLGDLLRFATIYMVFVMGFSQAYYIIFLSFDNPLTPEDVDDSATNPMSTPSESIMAMFLMSMTNFGDYYTAFART
EHEYEAKILFVIFMAIVAILLINMLIAMMGNTYQKIAETRNEWQRQWARIVLVVERGVSPPERLKQLNVYSQPMSDG
KRALVLRLNQSVRY

FIGURE 45 - SEQ ID NO: 66

<> 66
<> 905
<> PRT
<> Harpegnathos saltator
<> EFN81068.1
<> ?
>gi|307201162|gb|EFN81068.1| Transient receptor potential cation channel
subfamily V member 6 [Harpegnathos saltator]
MGNTESNVTSGVKKQTDTSSIMLYKLVDLKGGGLFVDMMKRAAQTKQFAELDHAVRTKVEPYLYNKGKGKWIPVDKL
VLLRNKDRPRHKMLAPLKAMENPADYDIDKDMGDEDVDETKIDKSKYRLVCWSLSERGAVGETILHLCMLNATALHA
DLAKRLLRFYPNLINDIYISDEYYGENVLHIAIVNEDPAMVKYLLDSGADVHERCFGNFMCPEDQKASRVDSLDHEW
VCVAPETNYSGYVYWGEYPLSFAACLGQEECYRLMLARGADPDKQDTNGNTVLHMLVIYEKLTTFDMAYEVGASLAI
RNVQHLTPLTLSAKLAKIEMFFHILNIEREIYWQIGSITCAAYPLSQIDTIDINIGTINKNSALNLVVFGEKDEHLE
LMDGMLVDLLNAKWNTFVKSRFYRQFFLFCFYFVLSLISFTLRPGPLPQETENANDTRTNSSNATAMEILRLFQSSD
LSNLVTNSLAAAFASNLKSSLNVTQESLEKIQLQVTSNITSALKNILPSLSDNEGILSAPDEAAIRTLWYTSSPYNE
SDYLTDAYNENVTSDANSTAGTIIGSIEVSKSNDKDNWWEDLTEECRLMQLTTISAKIRLTAEVLMEIAAVLYILAA
LREARFLGLNMFVENLMTAPSRVMFLFSCCILLSFPFLRLACADEVEDMLAVVVMLTTAPYFLFFCRGFKTVGPFVV
MIYRMIMGDLLRFVSIYLVFVMGFSQAYYIIFLSFDNPNTPEGVDDSVSNPMPSPMESIMAMFLMSMTNFGDYYGAF
ERTEHESEAKLLFVLYMAIVAILLVNMLIAMMGNTYQKIAETRNEWQRQWARIVLVVERGVSPAERLKKLMDYSQPM
SGGRRALVLRLNQSEEDKEEMKEILEMKRTHDRLLKKRQGRMSKEKVLAESEIIITRN

FIGURE 46 - SEQ ID NO: 67

<> 67
<> 903
<> PRT
<> Nasonia vitripennis
<> XP_001606102.2
<> ?
>gi|345488311|ref|XP_001606102.2| PREDICTED: transient receptor potential
cation channel subfamily V member 5 isoform 1 [Nasonia vitripennis]
MGNAESNVTSGVKKQTDAGAIALYKLVDLKGGGLLVDMMKRASQTKQYAEIDHAIRTKVEPFLYNGGKGKWIPIAKL
VLLRNKERGRHKMLPVLKAMEKPEDYDIDKDMANDPEPDENTIDKSKYKLVCWTLSDRGAVGETILHLCMLNATQLH
ADLAKRLLRFYPNLINDIYIDDEYYGENVLHIAIVNEDPSMVKFLLDSGANVNERCCGNFMCPEDQKASRNDSVEHE
WVCVCSETNYDGYVYWGEYPLSFAACLDQEECYRLILAKGADPDSQDTNGNTVLHMLVIYEKLETFDMAYEVGSSLS
IRNVLQLTPLTLAAKLARVEMFFHILNIEREIYWQIGSITCAAYPLSQIDTIDVDTGKISNNSALNLVVFGDKEEHL
KLLEGVLIDLLNAKWNTFVKSRFYQQFYLFFCYFILSLISCTLRPGPITKTDAPTTPHPMNDTSIESITPTSEPLE
LQTLSSLLAKNLAEQLVMGMKMYGNVSEDSLARISLQVASNISGSIKDIWTRQNLTSNDTDYVDIAGGLYADVNETS
ASDPFDLNASDIVILKKGKKELDDWWDDLTEDCRLMQMNSTSAKIRLTAEIFMEFGAILYICAALREARFLGLNMFI
ENLMTAPSRVMFLFSCCILLSFPFLRMSCADEVEDILAVVVMLTTAPYFLFFCRGFKTVGPFVVMIYRMIMGDLLRF
VSIYLVFVMGFSQAYYIIFLSFDNPITPEGVDDSKANPLPSAMESIMAMFLMSMTNFGDYYDAFENTEHEMLAKCLF
VVYMAIVSVLLVNMLIAMMGNTYQKIAETRNEWQRQWARIVLVVERGVAPAERLKKLNVYSQPMSDGRKALVLRLNQ
TDKDKEEMKDILEMKRIHIKSIKRRKDKLQKAKEDAEKLQQQMADKDNKDKAVIIQ

FIGURE 47 - SEQ ID NO: 68

<> 68
<> 903
<> PRT
<> Megachile rotundata
<> XP_003706172.1
<> ?

>gi|383861396|ref|XP_003706172.1| PREDICTED: transient receptor potential cation channel subfamily V member 6-like [Megachile rotundata]
MGNTESNVTSGVKKQTDSSSILLYKLVDLKGGGLLVDMMKRATQTKQYAELDHALRTKVEPYLYNKGKGKWIPIEKL
VLLRNKDRPKHKMLPPLRAMENPADYDIDKDMGEEEVDETKIDKSKYRLVCWSLSQRGAVGETIMHLCMLHATAIHT
DLAKRLLRFYPKLINDIYISDEYYGENALHIAIVNEDPAMVKFLLDSGADVHERCVGNFMCPEDQKASRTDSVDHEW
VCVAPETNYSGYVYWGEYPLNFAACLGQEECYRLILARGADPDKQDTNGNTVLHMLVIYEKMATFDMAYEVGASLSI
RNAQHLTPLTLSAKLARIEMFFHILNIEREIYWQIGSITCAAYPLSQVDTIDVNTGSISHTSALNLVVFGEKDEHLE
LMDGTMVDLLNAKWNTFVKSRFYRQFFLFCFYFILYLISFTLRPGPSVTSTATTAPTTESTTPKLPDPPPNFIPVTN
QKTFLEASLSSSLDEIVTNALNLNFPSNATARFDDLKLDLVTHIMSNLKNILNGNETKNEPFNSSQLARFDKHLFRE
NDTDYSTSILNETADVDSTTKFSFDNSVLFEADNKSDWWTDLTTECRLMQLTTASAKIRLIAEIFMEIAAILYILAA
LREARFLGLNMFIENLMTVPSRVMFLFSCCILLSFPFLRLSCADEVEDVLAVVVMLTTAPYFLFFCRGFKTVGPFVV
MIYRMIMGDLLRFVSIYLVFVIGFSQAYYIIFLSFDNPNTPEGVDDSVSNPMPSPIESIMAMFLMSMTNFGDYYGAF
ERTRHEMEAKFLFVVYMAIVAILLVNMLIAMMGNTYQKIAETRNEWQRQWARIVLVVERGVSPQERLKKLMDYSQPM
SDGRRALVLRLNQSEEDKEEMKEILEMKRTHERLYKKRQLKTTKEKTTITEENVTL

FIGURE 48 - SEQ ID NO: 69

<> 69
<> 887
<> PRT
<> Apis mellifera
<> XP_625170.3
<> ?

>gi|328787659|ref|XP_625170.3| PREDICTED: transient receptor potential cation channel subfamily V member 6 [Apis mellifera]
MGNTESNVASGVKKQTDASSILLYKLVDLKGGGLLVDMMKRATQTKQYAELDHALRTKVEPYLYNKGKGKWIPIEKL
VLLRNKDRPKHKMLPPLRAMENPADYDIDKDMGEDEVDETKIDKSKYRLVCWSLSERGAVGETILHLCMLHATAIHI
DLAKRLLRFYPKLINDVYISDEYYGESALHIAIVNEDPSMVKFLLDSGADVHERCIGNFMCPEDQKASRADSLDHEW
VCVTPETNYNGYVYWGEYPLNFAACLGQEECYRLILARGADPDKQDTNGNTVLHMLVIYEKLATFDMAYEVGASLAI
RNAQHLTPLTLSAKLAKIEMFFHILNIEREIYWQIGSITCAAYPLSQVDTIDVDTGSISHNSALNLVVFGEKDEHLE
LMDGILVDLLNAKWNTFVKFRFYRQFFLFCFYFVLSLISFTLRPGPATTSSVSNPQITSTELPTIPPKMDPPVHNSD
LPLLLDKILSTALVSKRYPWNLTRTRLDKLKLDIVENLTSALSDMLGTYRNEIKLFNRSDKTSIYSSRNDAKPIDET
VLRINSTILFNGDGISFTSKYNWWNNLTEECRLMHLDTLSTKIRLTAEVLMEIAATLYIFAALREARFLGLNMFIEN
LMTAPSRVMFLFSCCILLTFPFLRLICADEIEDMLAVVVMLTTAPYFLFFCRGFKTVGPFVVMIYRMIMGDLLRFVS
IYLVFVMGFSQAYYIIFLSFDNPNTPEGVDDSMSNPMPSPIESIMAMFLMSMTNFGDYYGAFERTQHEMEAKFLFVV
YMAIVAILLVNMLIAMMGNTYQKIAETRNEWQRQWARIVLVVERGVSPDERLKKLMDYSQPMSDGRRALVLRLNQSE
EDKEEMKEILEMKRTHDKLYKRRQSKTMKKILTSEDNVIL

FIGURE 49 - SEQ ID NO: 70

<> 70
<> 912
<> PRT
<> Apis florea
<> XP_003690006.1
<> ?
>gi|380011849|ref|XP_003690006.1| PREDICTED: LOW QUALITY PROTEIN: transient
receptor potential cation channel subfamily V member 5-like [Apis florea]
MGNTESNVASGVKKQTDASSILLYKLVDLKGGGLLVDMMKRATQTKQYAELDHALRTKVEPYLYNKGKGKWIPIEKL
VLLRNKDRPKHKMLPPLRAMENPADYDIDKDTGEDEVRDETRIDKSKYRLVCWSLSERGAVGETILHLCMLHATAIH
IDLAKRLLRFYPKLINDVYISDEYYGESALHIAIVNEDPSMVKFLLDSGADVHERCIGNFMCPEDQKASRADSLDHE
WVCVTPETNYNGYVYWGEYPLNFAACLGQEECYRLILARGADPDKQDTNGNTVLHMLVIYEKLATFDMAYEVGASLA
IRNAQHLTPLTLSAKLAKIEMFFHILNIEREIYWQIGSITCAAYPLSQVDTIDVDTGSISHNSALNLVVFGEKDEHL
ELMDGILVDLLNAKWNTFVKFRFYRQFFXFCFYFVLSLISFTLRPGPATTSSVPNPVAQTPLTSTELSTISPKVDPP
VSNVTVNRSSNAFQHDSNLSLLLDKILSTASVKYPWNVTRTRLDKLKLDIIENLTTALNNLLSTHRDEIEFFNHSYK
TTEYFHSTRNDTTPIDNLKITINETVLSVNSTILFNDGISFATGKYNWWNNLTEECRLMHVDTLSTKIRLTAEVLME
IAATLYIFAALREARFLGLNMFIENLMTAPSRVMFLFSCCILLTFPFLRLICADQVEDMLAVVVMLTTAPYFLFFCR
GFKTVGPFVVMIYRMIMGDLLRFVSIYLVFVMGFSQAYYIIFLSFDNPNTPEGVDDSMSNPMPSPIESIMAMFLMSM
TNFGDYYGAFERTQHEIEAKFLFVVYMAIVAILLVNMLIAMMGNTYQKIAETRNEWQRQWARIVLVVERGVSPEERL
KKLMDYSQPMSDGRRALVLRLNQSEEDKEEMKEILEMKRTHDKLYKKRQSKIMKKILTSEDNVIL

FIGURE 50 - SEQ ID NO: 71

<> 71
<> 823
<> PRT
<> Pediculus humanus corporis
<> XP_002427963.1
<> ?
>gi|242014577|ref|XP_002427963.1| conserved hypothetical protein [Pediculus
humanus corporis]
MGNTESNVTSGVKKQAGTSEQPLYKLVGLKGGGLLVDMMKRATQTKQYAELDHAIKTKIEPFLYNKGKGRLIPISQL
VLLRNCERSRTKLLPLLKNMEDPESEFDMDRDGNPGDFQPAPDGVQEDFHDYNKKYRDVCWDLKKRGAVGETCLHLC
MLNATSIHADLAKRLLKFYPKLINDIYMSDEYYGESVLHVAIVNEDPAMVKYLLDSGSNFHERCFGNFMCPEDQKAT
RTDSLDHEYVNLSTETNYEGYVYWGEYPLSFAACLGQEESYRLMLAKGANPDNQDTNGNTVLHMLVIHNKLPMFDVA
YEVGANLSLKNAKCLTPLTLAAKLARVELFFHILNIEREIYWQIGSITCAAYPLSQIDTIDIETGNISKNSALNLVV
FGEKDEHLELMDGVLVDLLVAKWNTYVKFRFYRQFISFFFYFLISVICFTLRPGPPTGTTTTTNGIVVLNNNNNNIT
SVVDNSNNVTTTTATTTATSYSFPGHVIVTLLSYDKYEDKIRIISELAMEIGSVLYLLGALREAKFLGIHMFIENLM
TAPSRVLFLGSCCIMQFVPWLRITCKEETEDIVAVIIMLTTAPYFLFFCRKMNDPVFLFLFFLIKKIFFLIFFFFFF
TKPTYYIIFLSFDNPKTPDGVDDSGTNPMQSPVESIMAMFLMSLTNFGEYYGAFEKTEHEFVAKLMFVVYMAIVAIL
LVNMLIAMMGNTYQKIAETRNEWQRQWARIVLVVERGVSPQERLKKLMLYSQPMSDGRRALVLRLHQTPEDKEEMKE
ILDMKRIHNRTVQRRKAKENKNVTFAGTPKNGIKNRLLGPVPPLKSIPSKPKI

FIGURE 51 - SEQ ID NO: 72

<> 72
<> 356, partial
<> PRT
<> Danaus plexippus
<> EHJ73092.1
<> ?
>gi|357621161|gb|EHJ73092.1| hypothetical protein KGM_12483 [Danaus plexippus]
MLESGGGLLVDMMKRAVQNKQYAEIDHAIKTKVEPFLYNKGKGRHIPISHLVLLRNKERGRHKLLPPLRGMENPDEE
FDVEKDWPVVTQEEYEANPSAYRELCWDLKERGAVGETILHLCLLNATSLLADLAKRLLRFYPKLINDIYMSDEYYG
ESVLHMTIVNEDPTMVKFLLDSGADYHERCFGNFMCPEDQKASRTDSFDHEWVNVQPDTNYDGYVYWGEYPLSFAAC
LGQEECYRLILARGANPDKQDTNGNTVLHMLIIYDKISTFDMAYEVGASLNIRNVQNLTPLTLAAKLARVELFFHIL
NIEREIYWQIGATTCAAYPLGQVDTIDTETGRISKDSALNLVVFGVS

FIGURE 52 - SEQ ID NO: 73

<> 73
<> 861, partial
<> PRT
<> Solenopsis invicta
<> EFZ14282.1
<> ?
>gi|322788689|gb|EFZ14282.1| hypothetical protein SINV_03089 [Solenopsis invicta]
GGLLVDMMKRASQTKQYAELDHAMRTKVEPFLYNKGKGKWIPIEKLVLLRNKDRPRHKMLPPLKAMENPA
DYDIDKDMGDEEVDEAKIDKSKYRLVCWNLSDRGAVGETILHLCMLNATAIHADLAKRLLRFYPLLIYDI
YLCDEYYGENVLHIAIVNEDPSLVKFLLDSGADDPRIIHERCFGTFMCPEDQKASRFDSMDHEWVCVTPE
TDYNGYVYWGEYPLSFAACLGQEECYRLILARGADPDKQDTNGNTVLHMLATFDMAYEVGASLDIRNVQH
LTPLTLAAKLARIEMFFHILNIEREIYWQIGSITCAAYPLSQIDTIDVNTGTINKTSALNLVVFGDKDEH
LELMDGMLVDLLNAKWNTFVKSRFYRQFFLFCFHFVLSLISFTLRPGPSTMETDENANDTSTKTNSSNIT
EPIILKPLQSSDLSELVTNSFVAAFASNLKSSLNMTQESLEKIQLQVTSNITSALKSILLLTLNENEGIL
SPPDEATIHTPWYTDSSPNTSDYFTDLYNKTVVAENSTVKAVVDDVAQTDYWWDDFAEECRLMQLTETSA
KIRLTAETFMYIAAVLYILAALREARFLGLNMFIENLATAPSRVMFLFSCCILLSFPFLRFVCADEIEDI
LAVVVMLTTAPYFLFFCRGFKTVGPFVVMIYRMIMGDLLRFVCIYLVFVMGFSQAYYIIFLSFDNPNTPE
GTDDSITNPMPSPMESVMAMFLMSMTNFGDYFGAFERTEHEFEAKLLFVLYMVIVAILLVNMLIAMMGNT
YQKIAETRNEWQRQWARIVLVVERGVSPAERLKKLTDYSQPMSDGRPALVLRLHQTEEDKEEMKEILEMK
RTHEKLLKKRQCRMSKEKILS

FIGURE 53 - SEQ ID NO: 74

<> 74
<> 861
<> PRT
<> Acromyrmex echinatior
<> EGI70573.1
<> ?
>gi|332030947|gb|EGI70573.1| Transient receptor potential cation channel
subfamily V member 6 [Acromyrmex echinatior]
MGNTESNVASSVKKQTDTSSILLYKLVDLKGGGLLVDMMKRATQTKQFAELDHAMRTKVEPFLYNKGKGKWIPVDKL
VLLRNKDRPRHKMLPPLKAMENPADYDIDKDMGDEEVDEAKIDKSKYRLVCWNLSDRGAVGETILHLCMLHATAIHA
DLAKRLLRFYPKLINDIYLSDEYYGENVLHIAIVNEDPSMVKFLLDSGADDPCIIHERCFGNFMCPEDQKASRFDNM
DHEWVCVSPETNYNGYVYWGEYPLSFAACLGQEECYRLILARGADPDKQDTNGNTVMHMLATFDMAYEVGASLGIRN
VQHLTPLTLAAKLARIEIFFHIMNIEREIYWQIGSITCAAYPLSQIDTIDVNTGTINNNSALNLVVFGDKDEHLELM
DGVLVDLLNAKWNTFVKSRFYNQFFLFCFYFVLSLISFTLRPGPSTIETDENANDTSTRTNSSNITEPIIHKTLQSS
DLSELVTNSLVAAFTSNFKSSLNMTQESLEKIQLQVTSNITSALKSILLLTLNENEGILSPPDEATIHTLWYTDSPP
NASDYFMNTYNKTDANSTVKTIIDGVARPKFKSNYWWDDFSEECRLMQLSEMSAKIRLTAEIFMFIAAVLYILAALR
EAKFLGLHMFIENLMTVPSRVMFLISCCILMWFPVLRFTCSDEVEDMLAVVVMLTTAPYFLFFCRGFKTVGPFVVMI
YRMIMGDLIRFVSIYLVFVMGFSQAYYIIFLSFDNPNTPEGIDDSITNPMPSPMESVMAMFLMSMTNFGDYFGAFDR
TEHEFEAKLLFVLYMAIVAILLVNMLIAMMGNTYQKIAETRNEWQRQEEDKEEMKEILEMKRTHDRLLKKRQNRMSK
EKIIFETEPIITKN

FIGURE 54 - SEQ ID NO: 75

<> 75
<> 904
<> PRT
<> Camponotus floridanus
<> EFN65752.1
<> ?
>gi|307175942|gb|EFN65752.1| Transient receptor potential cation channel
subfamily V member 5 [Camponotus floridanus]
MGNTESNVTSGVKKQTDTSSIVLYKLVDLKGGGLLVDMMKRATQTKQFAELDHAMRTKVEPFLYNKGEGKWIPIDKL
VLLRNKDRPRHKMLAPLKAMENPADYDIDKDMGDEEVDETKIDKSKYRLVCWNLSERGAVGETILHLCMLNATALHA
DLAKRLLRFYPKLINDIYLCDEYYGENVLHIAIVNEDPSMVKYLLDSGADDPRIIHERCFGNFMCPEDQKASRFDSQ
DHEWVCVTPETNYNGYVYWGEYPLSFAACLGQEECYRLILARGADPDKQDTNGNTVLHMLATFDMAYEVGASLDIRN
VQHLTPLTLAAKLARIEMFFHILNIEREIYWQIGSITCAAYPLSQIDTIDVNAGTINNNSALNLVVFGEKDEHLELM
DGVLIDLLNAKWNTFVKFRFYRQFILFYFYFVLSLISFTLRPGPQTDENANDTLTNSFNTTRESMILKSLHSSDLSE
LVTNSFTAAFTSNFKSSLNVTQESLEKIQLQVTSNVTSALRSILLLTLSNNEDLLSSPDEAAIHTLWYTDNPQNASD
YFINMYNKTVTIDTNSTAKTTIDDVTLLGKFNNHEKWWDDLTEECRLMQLTTMSAKIRLTAEIVMYFAAVLYILAAL
REARFLGLNMFIENLMTAPSRVMFLFSCCILMSFPVLRLSCSDEVEDVLAVVVMLTTAPYFLFFCRGFKTVGPFVVM
IYRMITGDLLRFVSIYLVFVMGFSQAYYIIFLSFDNPNTPEGVDDSITNPMPSPMESVMAMFLMSMTNFGDYYATFD
RTEHEFEAKLLFVLYMAIVAILLVNMLIAMMGNTYQKIAETRNEWQRQWARIVLVVERGVSPAERLKKLMDYSQPMS
DGRKALVLRLNQTEEDKEEMKEILEMKRTHDKLIKKRQDKILKEKALAETEAVITRK

FIGURE 55 - SEQ ID NO: 76

```
<> 76
<> 668, partial
<> PRT
<> Myzus persicae
<> in-house
<> ?
AIKTQVEPMLYNKGEGRMIPIAKLVLLRNRDRSRARWLPPLKNMEDANEYDIEKDIPTIEELEKLGEVQXXXXXXXX
XXXXXXXXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXARGADPNNQDTNGNTVLH
MLVIYEKISTFDMAYEIGAELNIRNVQNLTPLTLAAKLARIQMFFHILKIEREIYWQIGSITCAAYPLXXXXXXXXX
XXXXXXXXXXXXXXXXXXXXXHLEMMDGVLVDLLNAKWNAFVKFRFYRQFILFAFYFSISMVCFVLRPGPPPTGLKPP
LINYTSTSTTVATTPFDFMDNESMLPDNVMYDEMMIGGGGPTEFETPVVTTEMATVNDNATTNNGTGIIRTPLIYED
GAGGGGGSGTVSLHGKSSGSDRGKHRSTWNPANHTFKTNYTYNYNKSRKFWWNKRQKVCRLMAVHSTDDLIRMGSEV
GMFVGAFLYLLAAVREAGFLGSQMFIENLAIAPARVMFLFSCLLMMTIPPLRLTCYDKAEDIIAVIIMLTTCPYFLF
FCRGXXXXXXXXXVMIYRLVMGDLLRFVSIYMVFVMGFSQAYYVIFLSYDNPLTPEGIDDSVLNPMPTPTESIMAMFL
MSVNTFTDYYTAFDKTSHTLVAKFCFIVFMVIVAILPVNMLIAMMGDTYQKIAETRNEWQRQWARIVLVVERGVSPS
QRLKKLMYYSQPMSDGRRALVLRLNQTDEDKEQMKEILEMKRIHNRYVERMRARDLSSKLSSSCGKNANDGTINLKA
NK
```

FIGURE 56 - SEQ ID NO: 77

```
<> 77
<> 553, partial
<> PRT
<> Bemisia tabaci
<> in-house
<> ?
DPEKIDPKKCREVCWDLMERGAVGETILHLCLLNATSIHADLAKRLLRFYPKLINDIYMCDEYYGESVLHIAIVNED
PAMVKFLLDSGADYHERCTGNFMCPEDQKATRQDTVEHEWVNLSPLTNYEGYVYWGEYPLSFAACLGQEECFRLMLA
RGANPDNQDTNGNTVLHMLVIYEKLETFDMAYEVGANISVRNVQNLTPLTLAAKLARIEMFFHILNIEREIYWQIGS
IACAAYPLGQIDTIDIETGHISKNSALNLVVFGDKDEHLELMDGVLVDLLNAKWNAFVKLRXXXXXXXXXXXXXXXX
XXXXXXXXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXXXXXXXXXXXXXXXXXXXXXXXXXXXXXXXXXXXXXXXXXXXX
XXXXXXXXXXXXXXXXXXXXXXXXXXXXXXXXXIMLLTSPYFLFFCRGFKTVGPFVVMIYRMVMGDLLRFVSIYMV
FVMGFSQAYYIIFLSFDNPSTPDGVDDTVSNPMPNPVEAGMAMFLMSLNTFGDYFSAFEKTEHELEAKVCFVIFMGI
VAILLVNMLIAMMGNTYQKIAETRNEWQRQWARIVLVVERGVPPKERLTKLMWYSQPMSDGRRALVLRLNQTEQDKE
EMKEILEMKRVHNRIVEKRQKRLAKLSNNASPSNKPLVDLPNLSNHDSPTKPLLDLASNLSKF
```

FIGURE 57 - SEQ ID NO: 78

<> 78
<> 748, partial
<> PRT
<> Euschistus heros
<> in-house
<> ?
LRFYPKLINDVYMSDEYYGESVLHIAIVNEDPAMVKFLLDSGVNVNERCFGNFMCPEDQKASRTDSLDHEWVNLQSF
TTYEGYVYWGEYPLSFAACLGQEEXYRLMLARGANPDNQDTNGNTVLHMLVIYCKIQTFDMAYEVGGDLSIRNVQYL
TPLTLAAKLARIELFFHILNIEREIYWQIGSITCAAYPLSQIDTIDIVTGNISKNSALNLVVFGEKDEHLELMDGVL
IDLLNAKWNAFVKFRFYRQFFLFLFYFLISLICFTLRPGPPPVKPISSFNSTKPSGNNITAELSPESNATTVPKWIY
KTEIKKYDPEDNSSQNSRLNVILREVILTSLKVEDIDKVVSFSNAEPQDNSREDADGLVCNGDSVHSCLGNGSDVVA
VFGKGKSPKVPKPGASADDFDYDDTWWEEFGQCRLLQVTSYIEMTRLISEVLLDIGALLYILAALREARFLGWSMFV
ENLMTAPSRVMFLFSCCLMLTMPFLRFTCNEEIEDMMAVIIMLTTAPYFLFFCRGFKTVGPFVVMIYRMIMGDLLRF
ATIYLVFVMGFAQAYYIIFLSFDNPLTPEGVDDSVSNPIPNPMEAVMAMFFMSMTSFGDYYPALERTAHEFCAKLCF
VIYMAIVAILLVNMLIAMMGNTYQKIAETRNEWQRQWARIVLVVERGVSPSERLTKLMWYSQPMSDGRRALVLRLNQ
SEEDKEEMKEILEMKRIHNRMVQKRKEREKSMNKSPNLINLNSPAENVKNTNPFS

FIGURE 58 - SEQ ID NO: 79

<> 79
<> 734, partial
<> PRT
<> Nilaparvata lugens
<> in-house
<> ?
LHMAIVNEDPGMVKFLLNSGADFHERCFGNFMCPEDQKASRSDSFDHEWVNLWPVTNYEGYVYWGEYPLSFAACLGQ
EECYRLMLARGANPDNQDTNGNTVLHMLVIYEKMGTFDTAYELGANVSVRNIQNLTPLTLAAKLARIEMFFHIMNIE
REIYWQIGSITCAAYPLMLIDTIDIETGXISKDSALNLVVFGDKDEHLDLMEGVLVDLLHAKWNAFVKFRFYRQFIM
FFQYFLISCVCFILRPGPPEAHDGMNITANATLNLSFGVLEVRPEALQALLYRLEKLSLPQSGDLERFILESLADEK
SISEAALENDENRXPGWNNSVFSTYETLARDTGYQTDESPHDGLSSSMDYAEVAERLTKLMIDVNLTERSGAVNEII
LKALPSLEEKEDGLEEWWSGIAGDCILLQVNDLYDLARLCAEVALEIGAFLYLLAALREARFLGLKMMIENLMTAPS
RVMFLFSCCLMMTMPFFRFTCQDETEDILAVVIMLTTGPYFLFFCRGFKTVGPFVVMIYRMVMGDLLRFVSIYMVFV
MGFSQAYYIIFLTYDNPTTPEGTDDTTSNPLPSPIEAIMAMFFMSLTNFGDYYSAFENTEHEIEAKAFFVIYMVIVA
ILLINMLIAMMGNTYQKIAETKNEWQRQWARIVLVVERGVSPKERLKKLMSYSQPMSDGGRALVLRLNMTEEDKEEM
KEILEMKRVRDKIVMKRKKGLKLLGTTTPSPKRMKGRETPI

FIGURE 59 - SEQ ID NO: 80

<> 80
<> 162, partial
<> PRT
<> schistocerca americana
<> in-house
<> ?
LHMAIVNEDPAMVKFLLDSGANVHERCFGTFMSPEDQKAQRSDSLDHEWVNVNSDTNYEGYVYWGEYPLSFAACLGQ
EECYRLVLAKGANPDSQDTNGNTTLHMLVIHRKMTQFDMAYEVGSSLDIKNNLNLTPLTLAAKLARIEMFFHILNIE
REIYWQIG

FIGURE 60 - SEQ ID NO: 28

```
<> 28
<> 3372
<> DNA
<> Drosophila melanogaster
<> NM_132125.1
<> ?
>gi|24640230|ref|NM_132125.1| Drosophila melanogaster inactive (iav), mRNA
ATGAAGTTCCTCCTGAAGAAATGCCTGCGCAAGAAGGCGCCCGAGATGAAACCCGGGGCCATCCTGGATGCCGTCAT
CTCGCAATCATCGGCCACCGCGTGCAAGTGCCTGCTGTACAAACTGGCGGATTACAAAAGAGGTGGTGATCTCATCG
ATGCCATCAACTCGGGCGGACTGATTGCCGTGGAGCAGCTGATCCGGGAGCAGTTTGGCGTCTTCATGTACAACGAT
GGCAAGGGCCAGGTGATAAACCGTGCTGAGTTTCTGCGCTGGAAGTACCGCGACCACACCGAGGTGACCATACCCAT
TGAGGCATCCCTGTCCATCCACGATCCGCTGGGCAAATGGGAGGACCACAAGGCCTGCTGGCAGATGCAGTACCGCG
GCGCCCTGGGCGAGAGTCTGCTCCATGTGCTCATCATCTGCGATTCCAAGGTGCACACCAAGTTGGCGCGCGTGCTG
CTCCGCGTGTTCCCCAATCTGGCGCTGGATGTGATGGAGGGCGAGGAGTATCTGGGTGCTAGTGCCCTGCACCTGTC
GATTGCCTACAGCAACAATGAGCTGGTGGCGGATCTGATCGAGGCCGGAGCGGATATCCATCAGCGAGCGATTGGTA
GCTTCTTTCTGCCACGTGACCAACAGCGAGCGAATCCGGCCAAGAGCACCGACTACGAGGGACTGGCCTACATGGGT
GAATATCCGCTGGCTTGGGCCGCCTGCTGTGCCAACGAGAGTGTCTACAACCTGCTGGTGGACTGCGGATCCGATCC
GGATGCCCAGGACTCCTTCGGCAATATGATCCTGCACATGGTGGTCGTGTGCGACAAACTGGACATGTTCGGCTATG
CCCTGCGACATCCCAAGACGCCGGCCAAGAATGGCATTGTCAACCAGACGGGACTGACTCCACTCACTCTGGCCTGC
AAGCTGGGACGGGCGGAGGTCTTTCGTGAAATGTTGGAGCTGTCCGCCCGCGAGTTTTGGCGCTACAGTAACATCAC
CTGTTCCGGCTATCCACTGAATGCACTGGACACTCTTCTGCCGGACGGAAGGACTAATTGGAATTCCGCCTTGTTCA
TCATTCTGAACGGCACCAAGCCGGAGCATCTGGACATGTTGGACGGCGGCATTATCCAGCGCCTGCTGGAGGAGAAG
TGGAAGACCTTTGCGCAGAACCAGTTTCTGAAGCGTCTGCTCATCCTGTCCACCCATCTGCTATGCCTGTCCGTATC
GGTGTATTTGCGTCCAGCGCACGATGGTGAAGCCGAGGATGAGGACTCCGAGGGATCGGATGCCTCGGCAGCCGCTC
TGCTGGACATACAGTCGGATGAGGGCGACAGTGGTGGTGGTGACTACAATGCCCAGACGGTGGCCCGTTACTGCGCC
GAGTTTGCCACCCTGGTGGGAGTTTTAAGCTATGTGATCTTCCAGCAAGGCGACGAGATAAAGAACCAGGGTTTGTC
CGCCTTTCTCAAGCAGCTGTCCCATGCGCCGGCTAAGGCCATCTTCCTGTTCTCCAACTTGCTGATCCTGGCGTGCA
TTCCATTTCGTTTGATTGGCGACACCGATACCGAGGAGGCCATCCTGATTTTCGCTGTGCCGGGCTCCTGGTTTCTC
CTAATGTTCTTTGCTGGTGCCATTCGGCTGACGGGTCCGTTTGTGACCATGATCTATTCCATGATCACGGGCGACAT
GTTCACCTTCGGCATCATCTACTGCATCGTCCTGTGCGGATTCTCGCAGGCCTTCTACTTCCTCTACAAGGGACATC
CCCAGGTGCAGTCCACCATGTTCAATACCTACACCAGCACTTGGATGGCCCTGTTCCAAACCACACTGGGTGATTAT
AACTATCCCGATCTCAATCAGACCACATATCCCAATCTCTCCAAGACCGTGTTTGTCATCTTTATGATCTTCGTACC
CATCCTGTTGCTCAACATGTTGATTGCCATGATGGGCAACACCTATGTGACTGTGATCGAGCAGTCGGAGAAGGAAT
GGATGAAGCAGTGGGCCAAGATTGTCGTCACCCTGGAGCGCGCTGTTCCGCAGGCGGATGCCAAGGGCTATCTGGAG
GCATACTCCATCCCGCTGGGTCCGTCCGATGACTCCGGTTTCGAAGTGCGCGGCGTGATGGTCATCAAGAGCAAGAG
CAAGACGAGGGCCAAGCAGCGAAAAGGAGCCGTCTCCAACTGGAAGCGCGTGGGTCGTGTGACGCTAACGGCGCTCA
AGAAACGCGGAATGACCGGCGAGGAGATGCGTCGCCTTATGTGGGGCCGTGCCTCCATCTCCAGTCCCGTGAAAGTG
ACGAAGCAGAAGCTTAAGGATCCCTACAATCTGCACACGGACTCCGACTTCACCAACGCCATGACATGCTGACCTT
CGCTAGCAACCCGGCTTCCTCCAATGGCGTCACCCTGCGATCGGTAACAGCGCCTCCGCCCGCACCGCCAGCACCGG
ATCCCTTCAGGGAGCTGATCATGATGTCGGACCAGCGACCGGAGACCCATGATCCCCACTACTTTGCCGGCCTGCAG
CAGCTGGCCAATAAGGCTTTCGATTTGGTGGAGCAAACGATGAAGACACAGCCGCAAGCGCCGGTGGCCAAGAAGGT
GGATCCACTGCCAGTGGCTTCGGTGGCCAAAGCATCTCCAGCCGCTCCTGCAACACAAGCTACTGCTACTGCTGCTG
CTGCTTCCGATCTAATGGCCATGCCACTGCCCATTTCGAACTTGAGCAATCTTTTCCAAGACCCCAAGGACATTGTC
GATCCCAAAAAGCTGGAGGAGTTCATGGCCATGCTGGCCGAGGTGGAAACCGAGGAGAGCGACAGCGGCGGACCCAT
TCTCGGCAAGCTATCGCTGGCCAAACGGACACACAATGCCCTATCCAAGGCGGAAATTCGACGGGATCAGCAGGGAT
TCGAGGGTCACAGCCATGGACAGTTTCAGCCCATGTCCTCGGTGTGGGCACCACCTGGCCTGGATGTGGACACGGGC
TTCCACTTCGATGAAGCCGTCGCGGAGGAGGTGCTGACCATCGAACAGGAAGCCGAAGTGGAGACCGAGGACGGCAA
TGGTGGACAGGACAGCGAGGATATACCCACGGCGGAGGAGGTGCACGCCACTATGAAGCAGTTTCACCTGCGCAAGT
GCCAGCCAGCACAGGATGAGGCCGCTCGTCGCGCCAAAAGTGCTCGTGTTCGTCGCCGAAACAAAGTTTCGCCGGAG
CAAAGCGATGATCCGGACGAGCGCAGCCAGCGGGACGTTCCGCTTACACGCGGCGAACGCAATCGCCGCCCGATCC
GCTGGAACCATGGAGCACCCGCGAACTGCAGGACATCAACAAGATCCTGGCCAGAAAGTGA
```

FIGURE 61 - SEQ ID NO: 29

<> 29
<> 3387
<> DNA
<> Musca domestica
<> XM_005180960.1
<> ?
>gi|557762605|ref|XM_005180960.1| PREDICTED: Musca domestica uncharacterized
LOC101887788 (LOC101887788), mRNA
ATGAGGCTGTTCATGAAAAAGTGTTTGAGAAAAAAGCCTCAGGAATTGAAACCTGGAGCGATTTTAGATGCTGTCAT
TTCACAGTCATCGGCAACAGCTAGCAAATGTTTGCTCTACAAGTTGGCGGACTACAAACGGGGAGGCGACCTCATTG
ATGCCATCAACACCGGAGGGCTGGTGGCGGTGGAACAACTGATTCGCGAACAATTTGGCATATTCATGTATAACGAT
GGCAAGGGTCAGGTCATTAATCGTGCCGAATTCTTGCGTTGGAAATATCGTGACCACACCGAAGTGACCATACCCAT
AGAAGCCTCTTTATCCATACACGATCCATTGGGTAAATGGAAGGATCACAGTGCCTGTTGGCAGATGCAGTATCGTG
GCGCCTTGGGAGAGAGTCTGCTGCACGTCTTGATTATTTGCGATTCCAAAATGCATACCAAATTGGCGCGTATCTTG
TTGAGGGTGTTTCCTCGCCTGGCATTGGATGTCATCGAGGGCGAGGAGTATTTGGGTGCAAGTGCATTGCATTTGGC
CATAGCTTATAGCAATAATGAGTTGGTTGCCGATTTAATTGAGGCAGGAGCTGACATCAATCAGAGAGCCATTGGAA
GTTTCTTTTTGCCCAAGGATCAACAGAGAGCCAATCCGGCAAACAGTACAGATTACGAGGGTTTGGCTTATATGGGC
GAATATCCATTGTCATGGGCTGCCTGCTGCGCCAATGAAAGTGTCTATAATCTGTTGATTGATCATGATGCCGATCC
CGATGCCCAGGATAGTTTTGGAAACATGATCCTGCACATGGTGGTGGTGTGTGATAAGTTGGACATGTTTGGATATG
CTCTACGCCACCCCAAGACTCCGGCCAAAAATGGAATTGTTAATCATTCTGGTCTGACACCTCTAACATTGGCTTGC
AAATTGGGTCGGGCTGAGGTGTTCAGGGAAATGTTGGAACTATCGGCCAGAGAATTTTGGCGTTATAGTAACATTAC
CTGTTCGGGTTATCCTTTGAATGCTTTGGACACGCTGCTACCAGATGGGAGGACCAATTGGAATTCGGCCTTGTTTA
TTATTTTGAACGGTACCAAGGAGGAACATTTGGATATGTTAGATGGTGGGATTATACAGCGTCTGCTGGAGGAGAAA
TGGAAGACCTTTGCCCAGAATCAATTTCTAAAGCGTTTGCTGATTTTGGTGGTGCATTTGTTGTGCCTCTCAACGTC
GGTGTATCTGAGGCCAGCCCATGATGGCGATGATGACGAAGAAGATGAAACGGCTCAGGCTAATGCAGGACTACAGA
CCAATGATCCAGAAAACGAAGAATATGATATTCAAACAATAGTGAGATATTGTGCTGAGCTGTGTACCATTGCGGGG
GTCCTTAGTTTCCTGATTTTCCAACAAGGCGATGAAATAAAGAATCAGGGATTGTCAGCCTTCCTCAAACAACTGTC
CCATGCTCCAGCTAAGGTAATATTCTTGGTCTCGAATCTGATGATTTTGGCCTGCATACCCTTTCGCCTAATGGGTG
ACACGGACACAGAAGGAGGCCATACTTATATTTGCTGTGCCGGGAAGTTGGTTCTTGCTGATGTTCTTTGCGGGTGCA
ATTCGTTTGACCGGTCCCTTCGTAACCATGATCTACTCCATGATAACAGGTGACATGTTTACGTTTGGCATTATTTA
CTCCATTGTTCTGTGTGGCTTTTCCCAGGCGTTTTATTTCCTTTACAAAGGACATCCCCAATTGCAGTCGACTATGT
TTGATACCTTTCCCAGCACCTGGATGGCCCTGTTTCAAACCACTTTGGGAGATTACAATTATCCCGATTTGAATCAA
ACAACCTACCCGAACTTGTCGAAAACCGTTTTCGTTATTTTCATGATTTTCGTTCCCATTCTGTTGCTGAACATGTT
GATCGCCATGATGGGCAACACCTACGCCCATGTCATTGAACAATCCGAAAAGGAATGGATGAAACAGTGGGCCAAGA
TTGTGGTCACACTGGAAAGGGCAGTTCCCAAGCGGATGCAAAAAATTATCTGGAAGCCTATTCCATACCCTTGGGT
CCTTCGGATGATTCCGGATTTGAGGTTAGGGGAGTAATGGTCATTAAGAGCAAAAGTAAGACAAGAGCCAAACAACG
CAAGGGAGCAGTATCGAATTGGAAGAGAGTGGGCCGTGTAACGCTCAATGCCTTGAAGAAACGTGGTATGACGGGTG
AGGAGATGCGTCGTCTTATGTGGGGCCGAGCATCCATATCGAGTCCCATTAAAGTGGCCAAGAAGAAACTGAAGGAT
CCCTACAATCTAAATCAAGAGCCTGGGGGTCAATCCAATTTGACCAGTGCCATGGACATGCTTAATTTGCCAATGA
CCCAGCCTCCAGCTCGGGATTGGCTTTTAGAACTTCTGGTACTCAGGACCCCAAGGAGAAGAAGGATGTGCCACACA
TTCCCGCACCAGATCCCCTGCGTGATTTGGTTCTGTTAGCCGAAGAGAAGCCGGAAGTACACGATCCACAATTCTAT
TCAGCATTGATTCAGTTGGCCAACAAGGCCTATGATTTGGTGAAGAAAACCCTGGAAACCCAACATCAGCCACAAGT
TGAGGAGCCGATACCACTCACAGAGGCCACCAGTTTGAAGGACGTCACACTGACAAAACAACCCGATCCCGTTGCTG
CTGATGCTGGACTCCTTGGCGACATGGCCATGGGTGCCAATCTTACCAATCTCTTTCAAGACCCCAAAGATATTGTG
GACCCAAAGAAACTCGAACAATTTCTGAAAATGGTAGCTGATGTTGAGACCGAGGAAAGTGATGGAGGTGGTCCAAT
TTTGGGAAAACTTTCATTGGCCCGCAGGACACGCAATGCCCTATTTAAGGTACCCATACCCAAGAGTACTCTTGGCG
ACAGTTCGGATAAGTTAATTAATTCGGTGTGGGACAAGGTGCCAGCCGACAATGATGAGGACAGTATTCCGGCCTTT
GATTTCCAAGAAGCTCTGGCTGAACATGTCCTGACAGTGGAACAAGAGGCCGATGTGGAGACCGAAGATGCAAACGA
TGATTCGGGTGAGACCATGGACGATATACCCACAGCGGAGGAAGTACACGCTACCATGAAGCAATTTCATTTGCGTA
AGCGTCAATATCAGCAGGACGATGCAGCACGTCGTGCTAAGACGGCTCGAATAAGGCGCAAGAATAAAGTTGCTCCA
GATTATGCTGGGAGTGAAGAGCAATATGGACGTGGCCGTTCGGCACCCATGAAAAAGAAACATGATGAGGATGAAAT
GTCACCTCCTGATCCCTTGGAACCATGGAGTACTCGGGAATTGCAAAATATTAATAAAATCCTGGCAAAAAGTAA

FIGURE 62 - SEQ ID NO: 30

<> 30
<> 3435
<> DNA
<> Ceratitis capitata
<> XM_004529418.1
<> ?
>gi|498980909|ref|XM_004529418.1| PREDICTED: Ceratitis capitata
uncharacterized LOC101456642 (LOC101456642), mRNA
ATGAAATTCTTTTTGAAAAAATGTCTACGCAAAAAACCGGAGGAGATGAAACCAGGCGCCATACTGGACGCCGTCAT
TTCGCAATCCTCACCAATGGCCAACAAATGTCTACTCTACAAGCTGGCCGACTACATGCGCGGCGGTGACCTCATCG
ACGCACTGAACACTGGCGGCCTGGTCGCCGTGGAACAACTGATACGCGAGCAGTTCGGCATATTTATGTATAACGAT
GGCAAGGGACAGGTGATTAATCGTGCCGAGTTTTTACGCTGGAAATATCGCGATCACACTGAAGTTACTATACCGAT
TGAGGCTTCGCTCTCACGTCACGATCCGCTGGGCAAGTGGGAGGATCATAAAGCCTGTTGGCAAATGCAATTTCGTG
GGGCACTCGGTGAGAGTTTACTGCACGTGCTCATCATTTGCGATTCGAAAATACACACAAAGCTAGCGCGGGTACTG
ATACGAGTCTTTCCGAATCTGGCACAAGATGTGATGGAGGGTGAGGAGTATTTGGGTGCTAGTGCGTTGCATTTGGC
GATTGCTTATAGCAATAATGAGCTTGTGGCCGATTTGATTGAAGCAGGCGCTGATATAAATCAGCGTGCTATTGGCA
GTTTCTTTCTGCCGCGTGACCAGCAACGTCGAAATCCAGCCAAGTCGACGGACTATGAAGGATTGGCGTATCTGGGC
GAGTATCCGTTGGCATGGGCGGCATGTTGCGCCAATGAAAGTGTGTACAATTTGCTGGTGGACTGTGGTGCAGACCC
AGATGCACAAGACTCGTTTGGTAATATGATACTGCATATGGTGGTGGTGTGCGATAAATTGGATATGTTCGGTTATG
CTCTTCGCCATCCAAAAACGCCAGCCAAAATGGTATCGCCAACCACAGTGGACTCACACCGCTGACACTTTCTTGC
AAACTGGGACGCGCTGAAGTTTTTCGTGAGATGTTGGAGCTTTCCGACGTGAGTTTTGGCGTTACAGCAACATCAC
CTGCTCGGGTTATCCGCTCAACGCTTTAGATACTTTGCTGCCAGATGGACGCACAAATTGGAACTCGGCGCTGTTTA
TCATCTTGAATGGCACCAAAGAGGAACATTTGGATATGTTGGACGGCGGCATCATACAACGTTTACTGGAAGAGAAA
TGGAAAACCTTTGCTCAAAATCAATTCCTCAAACGTCTACTGATCCTAGTCATACACTTGGTTTTCCTCTCCATCTC
AGTTTATATGCGTCCCGCGCGTGTTGCAGACGATGATGATGAAGATGAGATAGATGCGTCTTCGAAAGACACTAAAG
CTCTTGAGCTTGCCACGGAATTGGATGAAGATGAGTACGATGTGCAGACTATTGTGCGCTACTGCGCAGAGTTTGGC
ACTATAGTGGGCGTATTGAGTTACGTTATCTTTCAGCAGGGAGATGAGATCAAAAATCAAGGTTTGCCAGCGTTCTT
AAAGCAGTTGACTCACGCTCCAGCCAAAGCTATCTTTCTAGTCTCTAATCTGCTAATTCTCGCCTGTATACCCTGTC
GACTCATGGGTGATACGGACGCCGAGGAGGCTATACTCATCTTTGCCGTGCCTGGCAGTTGGTTTCTGCTAATGTTT
TTTGCCGGCGCCATACGTCTGACGGGTCCTTTCGTTACTATGATATACTCCATGATTACAGGCGATATGTTCACGTT
TGGCATTATTTATTGTATCGTACTATGCGGCTTCTCGCAAGCTTTCTACTTTCTACAAGGGGCATCCACAAATAC
AGTCGACTATGTTCAATACCTTTCCCAGTACTTGGATGGCTTTGTTTCAAACCACACTCGGAGACTATAATTATCCC
GACTTGAACAATACAACATATCCGAACCTCTCGAAGACTGTATTCGTTATATTTATGATTTTCGTGCCGATTTTATT
GTTGAACATGTTAATCGCTATGATGGGCAACACCTACGCGCAAGTTATCGAAAGATCGGAGAAAGAGTGGATGAAAC
AGTGGGCAAAGATCGTGGTGACCTTGGAACGCGCTGTACCACAAGCTGATGCTAAGAACTATCTAGAGGCCTATTCA
ATACCACTCGGACCAATAGATGACTCCGGATATGAGGTGCGCGGTGTAATGGTTATCAAGAGCAAGGCGAAGACCAG
AGCTAAACAGCGTAAGGGTGCAGTTTCTAATTGGAAGCGCGTTGGTCGGGTCACATTGAATGCGTTGAAAAAGCGCG
GCATGACCGGCGAGCAAATGCGTCGTTTAATGTGGGGACGTGCATCCATATCAAGTCCGATTAAGATTACAAAAAAG
AAGTTGAAAGATCCCTACAATTTGAATCCACAAAATGATCTCACAAGCGCTATGGATATGTTGACCTTTGCCAATGA
TCCCGCAGCAAGCGCTGGTCTACAACTACGCTCCTCACTCATGGACTCCGGTGCCGAGGGCAAAGCAGCAAAAGTGC
AGGAGGAAAATCAGCAACCCGCACCAGATCCACTGCGCGACTTAATTTTCCTCGCCGATCGTCGTCCGGAAATGCAT
GATCCTCAGTATTTTGTTGGCCTACAGCAATTGGCAAATCAGGCATTGGATTGGTAGAACAAACAATGGGCATCCA
TCCACCACCCACTCCCGCAACTGATGCTTTACTTCTATCAGCAGCTGCTGCTACAACAACTATCGGTGCAGTGACAA
TGCAAACAGCCACAACTGTTGCCGCACCGAGCGCAGATTTAATTACCCCATTGGGCGCGAATTTAACAACGCTCTTT
CAAGATAACAAAGATGTCGTGGATCCGCAAAAGCTTCAAGAATTCTTGAAAATGTTGGCCGAGATCGAGACCGAGGA
GAGTGATGGCGGTGGTAGACCAATTTTGGGCAAGTTATCGCTTTCTCGACGTACAAAGAGCGCTCTTTCGAAGGCTC
AGATTAAGAAAGATCACGGTCGGTGGTAGTCCTGATAAATTGATCCCATCGGTTTGGTCACATAATTTACCGCAACCA
GATGAGGAACCGGAATTCAACTTCGAGGCTGCACTAGCCGAGGAACACACACTCACCATTGAACAGGAGGCTGAGGT
GGAGACCGAAACCGGCAACGAGCGTGAGGATAGCGAAGATTGTCCGACGGTAGAGGAGGTGCATGCAACAATGAAAC
AATTCCACCTGCGTAAGCGGCAATATCAACAGGACGACGCAGCACGACGAGCGAAAGTGCACGCATCAAGCGCAAA
AATAGAATTTCACCGGAACAATCCCATGAGTGTGATGACGGCAGCAGCGGCGGCGGAGGTAAGTCAACACACCC
ACGCGGCGCTTCAGCGCCAGGCCGTAAGCACACGGTGAGCGAACGCTTGTCGCCGCCGGATCCTCTGGAGCCGTGGA
GTACGCGCGAATTGCAAAATATCAACAAAATATTAGCGCGCAAGTGA

FIGURE 63 - SEQ ID NO: 31

<> 31
<> 3363
<> DNA
<> Aedes aegypti
<> XM_001659838.1
<> ?
>gi|157121230|ref|XM_001659838.1| Aedes aegypti hypothetical protein partial
mRNA
ATGGTCCAATTCGACTGGCGGCGTATGTGTCGCAAGAAGCGAAAGGTTCCTCAGGGCGGTGCTATCCTGGATCAAGT
GATTTCCCAGTCGGCCAATGCTTCTAATCAGTGCTTGCTGTATAAGATGGCTAATTACAAACGGGGTGGAGATTTGA
TCGATGCGTTCCAGGTCGGAGGGCAGAAGGCCGTGGAGCAGTTGATTCGGGAGCAGTTTTGGAGTTTTTATGTACAAC
AATGGCCGCGGACAGATCATCAATAGGGCCGAGTATCTACGGTGGAAGTACATGGATAATCATGAGGTCGTCATCCC
GATTGAGGCGTCGTTGTCTCCGCATGATCCTTTGGGCAAATGGGTCGATCATAAGGCCTGCTGGCAGATGCAGTATC
GTGGATTGCTGGGCGAGAGTTTGCTGCACGTGTTGATCATCTGCGATACGAAGATTCACACGAAGTTGGCCCGCATC
CTGCTGCGCGTGTTCCCCGAGCTGTCGATCGACGTGATGGAAGGCGAGGAGTACCTGGGCGCTAGTGCACTCCACTT
GGCGATCGCGTACAGCAACAACGAGTTGGTGGGCGATCTGATCGATGCCGGAGCGGACGTGTCCCAGCGCGCCATCG
GACGGTTCTTCCTTCCACGGGATCAGCAGGGCTTGAAGCCGGCCAAGAACACCGACTACGAGGGGTTGGCCTACTTG
GGCGAGTATCCGCTGGCGTGGGCCGCCTGCTGCGCCAATGAGTCCGTCTATAACCTGCTGCTGGAATGCGGGGCGGA
TCCGAACGCGCAGGACAGCTTCGGGAACATGATTCTGCACATGGTCGTCGTCTGCGATAAGCTGGATATGTTCGGGT
ATGCCCTTCGTCATCCGAAGCTTCCCTGTAAAAATGGGATCGTCAATGAGTCCGGACTCACGCCGTTGACCTTGGCC
TGTCGATTGGGTCGTGATGAAGTGTTCCGTGAGATGTTGGAGTTGTCGGCGAGGGAGTTTTGGCGGTACAGTAACAT
CACCTGTTCCGGATATCCGTTGAACGCATTGGACACGTTGATGCCCGACGGAACTACCAATTGGAATTCGGCGCTGT
TTATCATCCTCAACGGAACCAAGGAAGAGCATTTGAACATGCTGGACGGTGGCATCGTGGAACGTCTGCTGGACGAG
AAGTGGAAGACGTTCGCTCGGAACCAGTTCATCAAGCGACTGCTGATCCTCGCTCTGCATCTGTTCTGCTTGTCGTG
TTCGGTCTACTTGAGACCGGTGCGAGTTTTCAAGGAGGAGAGTGAAGAGGGAAGCGATGGAGGAGATGGAGCGGGTA
CAGCTGCTCCGGACGGTGTCGATGATGATGAGGACATTGATTTGACGACCTGGTTCCGGTATGGATTCGAGATCGCA
ACCGTGATGGGAGTACTGAGCTACGTGGTTCTTCAACAGGGTGATGAGATCAAGAATCAGGGATTGATCTCGTTTAT
AAAGTCACTTGGAAATGCTCCGGCGAAAGCTATCTTCCTGATCTCCAATCTGATGATCTTGGCTTGCATCCCGTTCC
GAATGATGGGTGACGTTGAACACGAGGAGGCCATTCTGTTGTTCGCAGTCCCAGGATCATGGTTCCTGCTGATGTTC
TTTGCTGGCGCCATCGGCTTAACAGGTCCCTTCGTCACCATGATCTTCTCTATGATCACGGGTGACATGTTCACCTT
CGGCATCATCTACATGATCGTTCTGTTCGGATTTTCCCAGGCGTTCTACTTCCTGTACAAAGGTCATCCGGAAGCGG
AGGATTCTCCATTTGGGAGCTACTTCGGCACTTGGATGGGCCTGTTCCAGACAACCCTCGGCGATTACGATTACGCC
GACTTGAATCTTACGACCTACCCGAACCTGGCGAAAACCGTGTTTATCATATTCATGATCTTCGTGCCGATCCTGTT
GTTGAACATGTTGATCGCTATGATGGGCAACACCTACGCGTACGTCATTGAGCAAGCTGAAAAGGAAGGCATGAAAC
AGTGGGCCAAGATCGTGGTCAACCTGGAGCGGGCGGTCAAGCAGGAGGACGCCAAAAAGTACCTGGAGGAGTACTCG
ATCGGGTTGGGACCGTCGGATGATCCGAGGTACGAGATCCGTGGAGTCATGGTCATCAAGAGCAAGAGTAAGACCCG
TGCCAGGCAGCGCAAGGGAGCGGTAAGTAACTGGAAGAGCGTTCTGCGTGTCACGTTGAACGAGCTGAAGAAGCGTA
ACATGACCGGCGAGGAGCTGCGGAGGATCATGTGGGGACGATCGTCGATCACTTCTCCGGCCAAGATCTCCAAGAAG
AAAAAGATCTACGAAGAGGAGGACCCCTTCGCCATCACCAATGCTATCGATGTGATGTCCTTCACGCAGGACATCGT
CATGGTAAGTAGCGAACCGACCGGACCGCCCACAATCGACCCCTCCAAACCGGCGACGATCGCCGTCAAGCCCCAAA
CGGCACCCGCAGCGCAACCGATCCCGGAGATTCCTCCTCAACCGCCGCTGGTCAAACGGCAGTCCGTGGTTAGTGCT
CCGCCGGCCTACGACGATTTCCCCCCGATGAAGGACTACAAGGATCCCCTGCGGGAGCTGGTCATCATCTCGGAGTC
GCCCTCGGTGGACGACCATTACGTGCAGAGCTGCAAGACCCTCGGAATGATGCGTCCACCCTGGATCACGACACCT
TGGGTCAGTTAAATCCCTTCCTGGAGGCGAAGGACGTGGTCGATCCGGTGAAGGAACGCGAGTTTCTCAAAACACTG
GAGGCCCTGGAGGACACCGACAGCGAAGCGGCCGAAAAGCCGGTCCTGGGCAAGATCTCCCTGATACGACGCGCCAA
GTCAGCCGTCTCGAGAACCACTTCCAGGAAGAAGAAAACCGACCAGCATCCGCTGTTTACGATCGCTTGGGATGACA
AGAACCTGACCCGGACGCATCCGGAGGACTTTGGAGCGCTGAACACGGCCTACGAGTACAGTGCCGAAGATTTCAAG
CAAGACGTGGACGAGGAAGCGAGGGAGGAGGAGGAAGACGAGGGTGTGACGGTGGAGGAAGTGCACCGCCGAATGGA
AGAGCTACACCATCGCGGCCGGGCTTCCTTGGAGCGGACAGCAACTCGACCGAGAGCAGCAAGAAACATCCGCACA
GGAAGCGGCAAGGTATGGGCCGAGGTCGGAACAACAAGGTGTCGCCGGATACGTCCAACGAGAGCGTATCCGGCAAG
AAGGACAAACGGATGAAGTCGGCGCCGACGGGTGGAGGGACCTCGCCACCGGATCCACTGGAACCATGGAGCACAAG
GGATATTTGCAACATTAATAAACTTTTGGACACCGATACGCAGGATGAGTAA

FIGURE 64 - SEQ ID NO: 32

<> 32
<> 3414
<> DNA
<> Culex quinquefasciatus
<> XM_001864290.1
<> ?
>gi|170057086|ref|XM_001864290.1| Culex quinquefasciatus OSMotic avoidance
abnormal family member, mRNA
ATGGTTAAGTTCGACTGGCGGCGGATGTGCCGCAAGAAGAAGAACGTTCCGCAGGGTGGTGCTATCCTGGATCAAGT
GATTTCGCAGAGCACGAACGTCCAGGGCCAGTGTCTGCTGTACAAGATGGCCAATTACAAGGGTGGTGGCGATTTGA
TCGATGCGTTCAAGATGGGCGGCCAGAAGGCGGTGGAGCAGCTGATCCGGGAACAGTTTGGGGTGTTTATGTATAAT
GCTGGCCGGGGTCAGATTATCAATCGGGCGGAGTATCTGCGGTGGAAGTATATGGATAACCATGAGGTTGTGATTCC
GATTGAGGCGTCGCTGTCCCCGCATGATCCTTTGGGGAAGTGGGTCGATCATAAGGCCTGTTGGCAGATGCAGTATC
GTGGGTTGCTGGGGGAGAGTCTACTTCATGTGTTGATCATCTGCGACACTAAGATTCATACCAAACTGTCCCGCATT
CTGCTGCGCGTGTTTCCGGAGCTGTCGATCGACGTGATGGAAGGCGAGGAGTACCTGGGCGCTAGCGCACTCCACCT
GGCGATCGCGTACAGCAACAACGAACTCGTTGGCGATCTGATCGACGCCGGGGCGAATGTGTCCCAGCGGGCCATCG
GGCGCTTCTTCCTTCCACGGGACCAGCAGAAGATGCATCCGGCCAAGACCACCGACTACGAGGGGTTGGCCTACCTG
GGCGAGTACCCACTGGCTTGGGCCGCTTGCTGCTCGAACGAATCGGTCTACAACCTGCTGCTCGAGTGTGGCGCAGA
TCCGAACGCGCAAGACAGCTTCGGAAACATGATCCTGCACATGGTCGTCGTGTGCGACAAGCTGGACATGTTTGGGT
ACGCGCTGCGGCACCCGAAGCTACCATGCAAGAACGGGATCGTCAACGAGGCCGGACTGACCCCGTTGACGCTGGCC
TGCCGCATCGGTCGAGACGAGGTGTTCCGTGAGATGTTGGAGCTGTCGGCGAGGGAGTTTTGGCGGTACAGTAACAT
CACCTGTTCCGGGTATCCGTTGAACGCGCTGGACACGTTGATGCCGGATGGTTCGACGAACTGGAACTCTGCGCTGT
TCATCATACTTAACGGAACAAAGGAGGAACATTTGAACATGCTGGACGGTGGTATCGTGGAGCGTCTGCTGGACGAG
AAGTGGAAAACTTTCGCCAGGAATCAGTTCTTGAAGCGTTTGCTTATCCTTGCACTGCACTTGTTTTGTCTGTCGTG
CTCGATTTACCTGCGACCGGTACATGTCTTCAAGGATGATGACGATGCAGATGACACCGATGGGGTTACTGATTCCC
CTGATACAACCGACGACGAGGGGATTGACCTGACCACGTGGTTCCGGTACGGGTTTGAAGTTGCCACCGTGATGGGC
GTGCTGAGCTATGTCGTAGTTCAGCAGGGTGAAGAAATCAAGAATCAGGGGTTTATATCGTTCCTCAAATCGCTGGC
TGGAGCTCCCGCTAAAGCGATTTTCTTGATTTCCAACCTGATGATTTTGTGCTGCATACCTCTGCGGATTCTCGGCG
ATAGAGAAGCTGAGGAAGCGGTGTTGTTGTTTGCCGTCCCCGGCAGCTGGTTTCTGTTGATGTTCTTCGCCGGTGCA
ATCGGACTAACTGGACCCTTCGTAACCATGATCTTTTCTATGATAACCGGTGACATGTTCACCTTTGGTATCATTTA
CACGATCGTACTGTTCGGATTCTCGCAAGCGTTTTACTTCCTGTACAAGGGTCATCCCAACGCGGACGAATCACCTT
TTGGCACGTACTTTGGAACCTGGATGGGACTGTTCCAGACGACCCTGGGCGATTACGATTACGCCGATTTGAACCTG
ACCACGTACCCCAACCTCGCCAAAACGGTCTTTATCACGTTCATGATCTTCGTGCCGATTCTGCTGCTTAACATGTT
GATCGCCATGATGGGTAACACCTACGCGTACGTCATTGAGCAAGCCGAAAAGGAAGGTATGAAGCAGTGGGCCAAGA
TTGTGGTCAACCTGGAGCGTGCCGTCAAGCAGGAGGATGCCAAAAAGTATCTGGAAGAGTACTCGATCGGGCTGGGA
CCTTCGGACGATCCACGGTTTGAGATTCGCGGCGTGATGGTCATCAAGAGTAAGAGCAAGACGCGAGCGCGGCAGCG
CAAGGGAGCGGTCAGCAACTGGAAGAGTGTGCTGCGTGTGACGTTGAACGAGTTGAAGAAGCGCAGCATGACTGGCG
AGGAGCTGCGCCGGATTATGTGGGGTCGATCGTCGATCACTTCCCCGGCTAAGATTTCCAAAAAGAAGAAGATCTAC
GACGAAGACGAGGATCCGTTCGCAATCACGGCAGCCATTGACGTGATGTCGTTCACGCAAGATATCGTGATGGTCAG
TACGGAACCGGTTGGTCCCCTCATGATCGACCCGACGAAACCTCCCGTCACCACCGTCAAACCTACCGCTCCGACCG
TTCCTTCTGCGCAACCTGCTCCAGGCGTTCCGATGACAACAGCGCAGACTGCGGCTCCTACGGCACCCCAGCTGGTC
AAGCGCCAGTCCGTGGTCAGTGCTCCGCCGGCTTACGATGACTTCCTCCCGGCGAAAGGCTTCAAGGATCCGCTGCG
GGAGCTGCTCATCCTTTCAGAATCGACCTCGATAGACGAGCACTACGCGCAAACGTGCCGTTCGCTGGCGACGGATG
CCTCTACCCTGGACCACGAGGAACACCAGCAACAGCAACAGCAGACCGTTGGCCAGTTGAATCCCTTCCTGGACGCG
AAAGACGTGGTCGACCCAGTGAAGGAACGCGAGTTCCTCAAAACCCTGGAAGCCCTCGAAGACACCGACAGTGAAGC
GGCCGAAAAGCCCGTCCTCGGCAAGATCTCGTTGATCCGGCGTGCCAGATCGGCCGTTTCGAGAACAACCTCCAGGA
AGAAGAAAACCGACCAGCATCCACTGTTTATGATTGCCTGGGACGACAAAACGACGACCATCCCCGGTGGGGGTCCC
CAAGCGGTATCGGCCACCGCCGGAACTGCTGCTCCGGAGGATGACTTTGGGGCACTGAACACGGCGTACAGTGCTC
GGCGGAAGATTTGAAGCACGACGTGGACGAAGAAGCACGGGAGGACGATCCAGACGAGGGCGTGACGGTGGAGGAGG
TTCACCGACGGATGGACGCGGTTCCACCAGCGGCCGGGCAGATCCTCGCCGGAACGGGACAGCAACTCGACGGAAAGC
AGCAAGAAGCAGGCCAAGGGAGACAAAACGCATGAAGTCGGCACCCAGCGGCCATGGGCCGCGCCATCGGCAGATGAT
GGACACTGGTGGTGGATCGCCGCCGGATCCACTCGAGCCGTGGAGCACGAAGGAAATTGTACCGATCAATAAGCTGC
TCGATACGGATACCCAGGACGAGTAG

FIGURE 65 - SEQ ID NO: 33

<> 33
<> 3651
<> DNA
<> Anopheles gambiae
<> XM_310685.5
>gi|347963768|ref|XM_310685.5| Anopheles gambiae str. PEST AGAP000413-PA
(AgaP_AGAP000413) mRNA, complete cds
ATGGTGCATCTCGATCCGCTGCGGCTATGCCGCAAAAAGCGCAAACTACCGCAGGGAGGCGCCATCCTCGACCAGGT
GATATCGCAGTCCGCGTCCGCCTCGAACCAGTGTCTCCTGTACAAGATGGCCAACTACAAGCGGGGCGGCGATCTGA
TCGACGCGTTCCAGATCGGCGGCCAGAAGGCGGTGGAGCAGCTGATCCGCGAGCAGTTCGGCGTGTTCATGTACAAC
AAGGGCCGGGGCCAGATCATTAACCGGGCCGAGTACCTGCGCTGGAAGTACATGGACAACCATGAGGTCATCATACC
GATCGAGGCCTCCCTGTCGCCGCACGACCCGCTCAGCAAGTGGGACGACCATAAGGCCTGCTGGCAGATGCAGTACC
GGGGCCTGCTGGGCGAAAGTCTGCTGCACGTGCTCATCATCTGCGACACGAAGGTGCACACCAAGCTGGCCCGCATC
CTGCTGCGCGTCTTCCCGGAGCAGTCGATCGACGTGATGGAGGGCGAGGAGTATCTTGGCGCGTCCGCCCTCCATCT
AGCCATCGCGTACAGCAACAACGAGCTGGTCGGCGACCTGATCGATGCCGGCGCGGACGTGTCCCAGCGGGCGACCG
GGCGCTTCTTTCTGCCCCGCGACCAGCAGGGCCTGCGGCCGGCCAAGACGACCGACTACGAGGGGCTGGCGTACCTC
GGCGAGTACCCACTGGCCTGGGCGGCCTGCTGCGCGAACGAGTCGGTGTACAACCTGCTGCTCGAGTGTGGCGCCGA
CCCGAACGCCCAGGACAGCTTCGGCAACATGATCCTGCACATGGTGGTCGTGTGCGACAAGCTGGACATGTTCGGGT
ACGCCCTGCGCCACCCGAAGCTGCCGTGCAAGAACGGCATCGTGAATGCGGCCGGCCTGACCCCGCTTACGCTCGCC
TGCCGGCTCGGCCGCGACGAGGTGTTCCGCGAGATGTTGGAGCTTTCTGCGCGCGAATTCTGGCGGTACAGTAACAT
CACCTGCTCGGGCTACCCGCTAAACGCGCTGGACACGCTCATGCCGGACGGCAGCACCAACTGGAATTCGGCCCTGT
TCATCATCCTGAACGGCACAAAGGAGGAGCATCTGAACATGCTGGACGGCGGCATCGTGAGCGGCTGCTGGACGAG
AAGTGGAAAACGTTCGCCCGGAACCAGTTCATCAAGCGGCTGCTCATCCTCGCGATACACCTGTTCTGTCTGTCCTG
CTCGGTCTACCTGCGCCCGGTCCGCGTGTTTGCTGATGACGAGGGCGAGGAGGGCGGAGACGCAACCGATGACGATG
GTGCGGACGATGGTGGGCCGATGGCGGTGGACGCGGTCGACGACGACATCGACCTGACGACCTGGGTGCGGTACGGC
TTCGAGGTGGCCACGGTGATGGGCGTGCTGAGCTACGTCGTACTGCAGCAGGGCGACGAGATCAAGAATCAGGGCTT
CTTCTCCTTTCTCAAGTCGCTGAGTCAAGCACCGGCGAAGGCGATTTTTCTGATATCCAACATCCTGATCCTGGCCT
GCATACCGCTGCGCATGATGGGCGACACCGAGACGGAGGAAGCCATCCTGCTGTTTGCCGTACCGGGCAGCTGGTTT
CTGCTAATGTTCTTTGCTGGTGCGATCGGACTGACCGGACCGGACCGTTCGTGACGATGATCTTCTCCATGATTACGGGCGA
CATGTTCACGTTCGGCATCATCTACATGATCGTGCTGTTTGGCTTTTCGCAAGCGTTCTACTTCCTCTACAAGGGCC
ACCCGAACGCGGAGGACAGCCCGTTCGGCAGCTATTTCGGCACGTGGATGGCGCTGTTCCAGACCACGCTCGGCGAC
TACGATTACGCCGATCTGAACCTCACCACCTACCCGAACCTGGCGAAGACGGTGTTTGTCATCTTTATGATCTTCGT
GCCGATCCTGCTGCTGAACATGCTGATCGCGATGATGGGCAACACGTACGCGTACGTGATCGAGCAGGCGGAGAAGG
AGGGCATGAAGCAGTGGGCGAAGATAGTGGTCAATCTCGAGCGGGCGGTGACGCAGGACGACGCGAAGCGCTACCTG
GAGGAGTACTCGATCGGGCTCGGGCCGTCGGACGATCCGCGGTACGAGACGCGCGGCGTCATGGTGATCAAGAGCAA
GAGCAAGACGCGGGCCGCCAGCGCAAGGGCGCAGTGAGCAACTGGAAGAGCGTGCTGCGCGTCACGCTGAACGAGC
TGAAGAAGCGCAGCATGACGGGCGAGGAGCTGCGACGCATCATGTGGGGCCGCTCGTCCATCACGTCGCCGGCGAAG
ATCGCGAAGAAGAAGCGGCCGGGCGAGGTGGACGATCTGCTCGGCGATCCGTTCGCGATAACGGCCGCGATCGACGT
GATGTCGTTCACGCAGGACATCGTGATGGTTAGCACGGACACGGTCTGCCCGATCACGATACCGCCAGCGGCTGCCC
CGGGCACGGCGGCCCCGAAGGCTGGTGGCACCAAACCGGTAGTAGTGGCACCGCCGCCGCCAGCAGCAGCAACAGCA
GTACAGCAACCACCGCCGCCAGCGACGACGCGGCGCCACTCGACGGCAAGCGCACCGGCCACGATGGGGCTGGGCGT
GGAGGCGGCCCTGCCCGGCTACAAGGATCCGCTGCGCGAGCTCGGTCATCATCTCCGAGTCGGCCTCGGTCGACGAGA
ACTACGCCAGAACGTGAAAACGCTCGCGATCGACGCGTCCACGCTCGACCACGTGCACGAGATCGACATCAGCCAG
CAACAGCAGCAACAGCAGCAACAGCAGCAGCAACAGCCCCAGCAACCCCAGCAGCAGCAGAATCTCGGCCAGCTGAC
CCTCTTCCAGAACCCGAAGGACGTCGTGGATCCGGTGCGGGAGCGCGAGTTTCTCAAAACGCTCGAAGCGCTCGAGG
ACACGGACAGCGAGGCGGGCGAGAAGCCCGTCCTCGGCAAGATCTCGCTGATCCGGCGGGCCAAATCGGCCGTCTCG
CGCAGCACGTCGCGCAAGCGCAAAACCGACCAGCACCCGCTGTTCATGATCGCGTGGGAGGACAAGGGCGACCAGCA
GCGGCACAGCACAGCGCTGTACGATGGCGCGACGGGTGCGGCCCCGTCGGTCGGTGCGCCCGGCGAGCTGGGGCAGC
CGGAGCAGCCCGAGGACGCCGTCACGGTCGAGGAGCTGCACCGGCGGATGGAGCAGTTCCACCAGCGGGCGTCCGTG
CGCGAACGGGACGCGAACTCGAGCGAGAGCGGCAGCGGCAAGCAGCACGCCGGCCCGAAGGCACGGAAGCCGTCCCA
CCATCGGGACGGTGGCGGCTCCCATCATCACCATGGGCTCGGGCGGGCAAGCACAACAAGATATCGCCCGACAACT
CGAACGAAAGTACGGGCGGTGGCGGCGGTGGCGGCGCCAGTGGCCACGGGCGCAAGCAGGACAAGCGCATGAAGTCG
GCCCCGATACTGGGCAGCGGCGGTGCGGGCAGTGCCGGTAGCAGTGCCGGCGGGCGGACGGTGGCGCCCGGTGGTGC
CCGACCGGACGATGGTACCGGGTCGCCGCCGGACCCGCTCGAACCATGGAGCACCAAGAACATCATGAACATCAACA
AGCTGCTGGACCAGGACACGACCGAAGAGTAG

FIGURE 66 - SEQ ID NO: 34

<> 34
<> 3261
<> DNA
<> Tribolium castaneum
<> TC012368
<> ?
>TC012368-PA    TC012368
ATGGGTGCAAAAGTGTGCAAACCGTGTAAAAAGCGCAAAGCCAACACCTTCCAAGGGGGCTCCATCCTCGACCGGGT
CATCAGCCAAGCCTCAAACCAAGACCAGTGCCTCCTTTACAAATTAGCAAATTACAAGAAAGGCGGCGAACTGATCG
ACGCGTACAACCAAGGGGGCCAAGCCGAGGTGGAAAAATTAATACGCGAGCAATTCGGCCAGTTGATGTACCAGGAA
GGCAAAGGCCAGATAATCAACCGCTCGGAGTATCTCAGGTGGAAATTTCGCGACCACGAGCAGGTCATTCTCCCAAT
CGAGGCCTCCTTGAGCCGATACGACCCCCTGGCCAAGTGGAACGACCACGAGGCGTGCTGGCAGATGCAGTTCAGGG
GGTCTTTAGGCGAGTCTTTGCTGCACGTCCTCATAATTTGCGACACGAAAATTCACACAAGACTGGCGCGGACTCTG
ATCAAGTGTTTCCCGAAGCTGGCCCTCGACGTTGTCGAGGGCGAGGAGTATCTAGGGGCGAGTGCTTTGCACCTAGC
GATCGCTTACAACAACAATGAGCTAGTCCAGGACTTGGTCGAAGCTGGTGCTAACGTGAACCAGCGCGCCATTGGGA
GCTTTTTCCTCCCGAGGGACCAACAACGCCAAAAACCCGCAAAACACACCGACTACGAGGGGCTCGCCTACTTGGGG
GAATACCCTCTGGCCTGGGCCGCGTGTTGCGCCAACGAAAGCGTCTACAATCTGTTGCTGGACAGTGGGGCGCACCC
CGACTATCAGGACAATTTTGGAAACATGATCTTGCACATGGTGGTGGTTTGCGACAAGTTGGACATGTTCGGCTACG
CCTTGAGACACCCGAAACTACCGGCAAGCAACGGAATTGTGAATAAAGCAGGTCTAACTCCCCTAACGCTGGCTTGT
AAGCTGGGTCGGGCTGAGGTTTTCCGCGAAATGTTGGAGCTTTCAGCCAAGGAGTTTTGGAGGTATAGTAACATCAC
CTGCTCGGCGTATTTTTTGAACGCTTTGGATACGCTGCTACCGGACGGGCGCACAAACTGGAATTCGGCCCTTTTCA
TTATTTTAAACGGAACCAAGGAAGAGCATTTAGCCATGCTTGACGGTGGGATTATCCAACGACTGTTGGAGGAAAAA
TGGAAAACATTCGCACGGAACCAATTTTTGAAACGGCTTCTTATCCTCGTTGTGCATTTGTTGTTTCTGTCTTTGGC
GGTTTACTTGCGACCAGACGACCCAGACGAGTCTCTTCTCACCTGGTCTGATGATGTTACACTGATAGCTAGATATG
TGTGTGAAGTGGGCACGATTTTGGGCGTCCTCAGTTATCTGGTTTTGCAACAAGGGGACGAAATCCGTAATCAGGGA
CTTACTGCGTTCTTGAAACAACAACTGAATTCACCCCCGAAATTAATTTTCCTCATTTCGAATTTCCTAATTTTGGC
GTGCATTCCATGCAGGTTGTATGGCGATAAGGAAACCGAGGAGGCTATTCTGTGTTTTGCGGTACCTGGGTCTTGGT
TTCTTCTCATGTTTTTGCAGGGGCCGTTCGTTTGACTGGTCCTTTTGTCACAATGATTTACAGCATGATTACCGGC
GATATGTTGACTTTTGGCATCATTTACACCGTTTTCTTATTTGGTTTTTCGCAGTCGTTCTATTTCCTGTATAAGGG
ATTCCCCGGGGTCAAAACTTCCTTATACAACACGTACATGTCGACTTGGATGGCCTTATTCCAAATTACTTTGGGCA
ATTATGAATATTCTGAGTTGAGTGCCACCACATACCCAGCGGTCAGCAAAACAGTCTTTGCCATCTTCATGGTGTTC
GTCCCAATTTTGCTGCTCAACATGTTAATCGCCATGATGGGCAACACTTACGCCCATGTAATCGAGCAAAGCGAGAA
AGAATGGGTCAAACAATGGGCAAAAATCGTCATCGCCCTGGAACGGGCAATCCCACAATCCGACGCCCAACATTACT
TACAAGAGTACAGTATTTCGCTGGGGCCCAGTGAACAGGACCCCAGTACCGAAAAACGCGGAGTTTTGGTCATAAAA
TCAAAGAGTAAAACGCGGGCAAAACAACGAAAAGGGGCCGTGGCCAATTGGAAGCGGGTGGGCAAAGTAACGATAAA
CGCGCTCAAAAAACGCGGCTTAACCGGTGAAGAAATGCGCTGCTTGATGTGGGGCCGCGAGTCTATTAATACACCGG
TCAAAACAAAGAAGCCTGTGAAGGACCCACTGCTGGACCCGCAAGGGCCGAATTTAACGGGTGGCTTCGGCGATGCT
TTAACCACTGCTTTGGATGTGATGACGTTCACGCACGATTTGGATATTGTGGGGCTTCCCAGGGCCTGAATTTGGC
CACGAACCCTAAACCCGTCCCTCCCACAACAACAGCGAGTGCCGTGACTGTGAATAACCAGATAAATTCGGCTCTGA
ACGCGCAGCAAAAGGCCGTAGCTGGGGCTGGAGTTGGTGCTTTGGCTATGATAGGCACAGTGACCCAACTCACCGAC
TCTCAAGGCTACATTATGCAAAACAGTGTGAAAAAGAAGAAAAATTGTCGCAACTTTGGAGGACCCTTTCAGGGA
ACTTGTCATAAACGCTAATGACAGTAACTGCGACCCGGAAAATTAAAAATGCTTGCGCTATCGGCCGCCAATTTGA
AAGACGTTGAAGAGTTATCGGTGGCCAAGCCACAAACGAAAAGTGTTAAGAGTCTAGCGGGGATTTTCGCCGGGACT
GAGACTTTTGTGAGGAAAGTTGAAGAAACAATAAAGAAGAAATATGCGGCTTTGGATCCAAGTGATAGTGAAGGTTT
TGGCGAACCTCCACTATTAGGGAAAATATCCAGGACTAGAAGGGCAAATCGGCAAACTTGCGCAACTCTTCAGCGC
GATCTAAAGCTTCAGATAAGAAAAAACTGGTCGCGGGGTCACAGTCAAGCTCCACTGATACGGTCAATAACGAATT
AATGAAAGAATATCGAAAATTCTGACTTAGACTATGCCGAAGAGAGGATCAAGCTGGTGAAAGAGTCGTTAAAGCA
GGTGGTTGACGTTGCGCAAATTCGGCCGATTAACATCGATGTGGCCCTCGAGGAGCAAGTGTCGGTCACAATTTCGG
AAACGATGCGAGTGCAGGGCTCCGGGGACGGGGCCGAAGTCCAGTCATCCAACGTCAAACCAAAGCGCAAAAAACGG
AGCAAAACAGCCAAAAACAACAAGTAA

FIGURE 67 - SEQ ID NO: 35

<> 35
<> 3306
<> DNA
<> Megachile rotundata
<> XM_003704618.1
<> ?
>gi|383858352|ref|XM_003704618.1| PREDICTED: Megachile rotundata
uncharacterized LOC100877549 (LOC100877549), mRNA
ATGGGTGGTGTCTGCTCCTGTCGAGGTCTCGGTAGCCAGGTTAACGCTGGCTCGATTCTCGATCGTGTGATCAGTCA
AGCGAGCGACGAGGATCAATGTTTGCTATATCGTCTGGCCAATTACAAGAAGAGTGGCGAGCTGATAGACGCGTACA
ATCAAGGTGGCCAGGCAGAGGTGGAAAAATTGATCAGGGAACAGTTTGGTGTACTGATGTACGCGGACGGCAAGGGT
CAGATGATCAATCGGGCAGAGTATCTGCGCTGGAAATTCCGGGACCTGGAACAGGTCGTGCTTCCTATAGAAGCTTC
CTTGTCACGATTCGATCCTCTGGCTCAATGGAACGATCACCAGGCATGCTGGCAGATGCAATACAGAGGTTCCCTCG
GAGAAACCCTCTTGCATGTTCTGATCATATGCGATACCAGGTTACATACACGGCTGGCGCGTATCCTGCTCAAGTGC
TTTCCACGATTGGCCATCGACGTAGTAGAGGGCGAGGAATACCTCGGTGCTAGTGCTCTACACCTGGCGATCGCGTA
CAATAATAACGAACTGGTGCAAGACCTCGTTGAAGTGGGTGCGATTATTTCTCAACGCGCGATCGGCAGTTTTTTCC
TACCCAGAGATCAACAACGAATGAACCCGGCCAAGAATACCGATTACGAAGGATTAGCCTACTTAGGAGAGTATCCT
CTTGCCTGGGCCGCCTGCTGCGCGAACGAGAGCGTTTATAACTTGCTGCTCGACTCCGGTGCGGATCCTGACGAACA
GGATTCTTTTGGCAATATGATACTGCACATGGTGGTAGTTTGTGATAAACTGGACATGTTCGGGTATGCCCTCCGCC
ATCCAAAGCTTCCAGCTCGCAATGGGATCGTGAATGCCGCTGGACTGACCCCATTGACCCTCGCCTGCCAGCTGGGT
CGTGCAGAGGTCTTCCGGGAGATGTTGGAACTGTCTGCACGAGAATTCTGGCGCTACAGTAATATCACCTGCTCGGC
GTACCCCCTCAATGCACTCGACACGCTGTTACCCGACGGCAGAACAAACTGGAACTCTGCGCTATTTATCATTCTGA
ACGGTACCAAGGAGGAACACTTGAACATGCTGGACGGTGGTATTATTCAGCGATTACTCGAGGAAAAATGGAAGACC
TTTGCGCGGTTACAGTTCTTGAAGCGTTTGATCATCCTGGTATTTCACCTGACATCACTGTCTCTGGCCGTCTACTT
AAGACCCTCAAACCTCGATACGGTTCTCCTGAAGTGGCCAGAGGAAGTAACAGAAGTTGGTCGAACCATAGCTGAGT
GTATCACCGTGCTAGGCGTCCTGAGTTATATTTTAGTGCAACTGGGCGGTGAAATCATCAACATCGGTGTTCTCTCG
TTCCTGAAGCAGCTGAGTCACGAGCCCGCCAAACTGATATTTCTGATCAGCAACTTGCTCATACTGGCGTGCATTCC
GTGTCGTCTTGCTGGAAACAGGCATGCGGAAGACGCAATCCTCGTCGTTGCTGTTCCTGGTTCCTGGTTCCTTTTGA
TGTTTTTTGCTGGCGCTATCCGGCTGACCGGTCCATTCGTCACCATGGTCTACAGCATGATAACCGGCGACATGTTG
ACCTTCGGAATAATCTACATGGTTGTGCTGTTCGGTTTTTGCCAGTCGTTCTACTTTTTGTACAAAGGCTTTCCAGG
AGTGAAATCATCCCTCTATAGTTCCTATCACTCGACATGGATGGCACTGTTTCAAGTAACCCTCGGCGATTATAACT
ACACAGATCTTAGTTACACAACGTATCCGAATTTATCGAAGATGGTGTTCACTATATTCATGGTCCTGGTGCCTATA
CTACTCCTGAACATGCTAATTGCCATGATGGGCAACACTTACGCACACGTGATTGAGCAAAGCGAGAAGGAGTGGGT
GAAGCAATGGGCGAAAATCGTGGTCTCTCTGGAGCGAGCAGTATCTCAAAAAGACGCTCAGAATTATTTGCAAGAAT
ACAGTATTAAATTAGGACCTGGAGATGACCCGAACAACCCAGCGTCGGAGCAACGTGGTGTTCTGGTGATTAAAAGT
AAATCGAAAACCAAGGCAAAGCAACGCAAAGGTGCTGTTGCTAACTGGAAGCGTGTCGGAAAAGTGACGATCAACGA
ATTAAGAAAACGTGGAATGACGGGAGAAGAGTTACGACGAATAATGTGGGGTCGAGCCTCTTTTTCGACACCAGTTA
GAGTAAGTCCAAATGTAGATGAACCTCAGGTTTCAGCGGTAACTGCTGGTTTTGGGGATGCATTAACAGCAGCACTG
GACGTTATGGCGTTTGCCCATGACTTGGACCTCTCCACTGCCACAGAATCGATTCCTACTAATATTGACGTAAAACA
ATCGAAACCAAAGGTTGTCAGCAGCGAACAAACCAAATTAACGACAAATAATCAAGAAAAACCATCGATAACAGAAA
AAGCTGCCACGGAGATCGCGAATAAACAAGTAAACGCTAAAGATGAGACCAATAAGAAACCTAATGAAGTTGTCGAC
GTTGAGAAAATGAATGTGAAGAATGCAAACAATTCAAGCACAGTTGAAGAGTATCATGATCTGTTTTTGGAATTTGT
GATTGCTTCGGAAAGTATGAACGATCCTGAAACGCTACTAAAAATGGCGGAACGTGTTGCTGCAGAATTTGATTCGT
CTGCGAATCCCAAAATAAATTTGCAAATTTTGGAACAGTTCACGATGACGAAAATACCGATGGAGGAACAAGCTGCA
GCTGTTAAGAAACAATATTTTATCGAATCCAGCGATAACGATTTTGGCGGCGACAACTTGCTAGGAACGGTGGCCCG
TTTACGTAGAATAAGATCAGCTAACAGCAGATTTATCACGGCACGGAGACATTCACGGCATGTCAATGACGACATGT
CATCGACGTCTTCCGCATCCGGCGACGGAAATCCTCGATACCAGCAGTTGCTAAACGACACTGAAGAGGTACCGTCG
AATCAACGGACCGAAAATCGAGATGAGTCAATCGTGGCGAACAAATCGGAAGTAAAACAAAACGATGCTAACTGCGG
ATCGAGGTGCAAAGCTCAGAAGCGTCGACCAAAAACTGCTAGAAACAGGGTATCGCCGAAGGAAACGGAGGATTCCG
GCCAAAGGAGAAGAGAATCGATGGAGCGGAATAAGGCGGTTTCACCGGCGACATCGCCCACCGATCCGCTCGAGCCA
TGGAGCACACGCGGAATTAAAGACATGAACACGATATTGGCTTGGGAGGAAAATGTGCCGGACAGTCCTTAA

FIGURE 68 - SEQ ID NO: 36

```
<> 36
<> 3306
<> DNA
<> Apis mellifera
<> XM_001121881.2
<> ?
>gi|328783035|ref|XM_001121881.2| PREDICTED: Apis mellifera inactive (Iav),
mRNA
ATGGGTGGTGTCTGCTCGTTTCGAGGTCGCGGTAGCCAGGTGAACGCTGGCTCGATCCTCGATCGTGTGATCAGTCA
AGCGAGCGACGAGGATCAATGCCTGTTGTATCGTCTGGCCAATTACAAAAAGGGTGGCGAGCTGATCGAGTCGTACA
ATCAGGGTGGCCAGTTCGAGGTAGAAAAATTGATCAGGGAACAGTTCGGTGTGTTGATGTATGCGGACGGTAAGGGG
CAGGTGATCAATCGTGCCGAGTATCTACGCTGGAAATTCCGAGACCTCGAGCAAGTTGTGCTCCCTATCGAGGCTTC
TTTGTCGCAGTTCGATCCTCTGGCTCAATGGAACGATCACGAGGCGTGCTGGCAAATGCAGTACAGGGGCTCGCTGG
GAGAGACCCTCCTTCATGTCCTGATTATATGCGATACCAGGATACACACGCGAGTGGCCCGTATTCTGCTCAAGTGC
TTTCCACGATTGGCCATTGACGTAGTCGAGGGCGAGGAGTACCTTGGCGCTAGCGCGCTCCATCTAGCGATCGCGTA
CAACAATAATGAACTGGTGCAAGACCTGGTTGAGGCGGGGGCGATCATTTCTCAGCGGGCGATAGGCAGCTTTTTCC
TACCGAGGGACCAACAACGAACGAATCCGGCTAAGAATACGGATTACGAGGGATTAGCTTATCTGGGGGAATATCCC
CTCGCCTGGGCCGCTTGTTGTGCAAACGAGAGCGTTTACAACTTATTACTCGACTCTGGCGCTGATCCCGACGAGCA
AGACTCTTTTGGAAACATGATATTGCATATGGTCGTGGTTTGTGATAAATTGGACATGTTCGGATATGCTCTCCGTC
ATCCGAAGCTTCCTGCTCGCAATGGGATTGTGAATGCTGCCGGACTGACCCCATTGACGCTCGCCTGCCAGCTGGGC
CGTGCTGAGGTCTTTCGGGAGATGTTGGAACTGTCCGCACGAGAATTCTGGCGCTACAGTAACATCACCTGCTCGGC
GTATCCCCTGAATGCGCTCGACACGCTGTTGCCCGATGGCAGAACAAACTGGAACTCGGCGCTATTTATCATTCTGA
ACGGTACGAAGGAGGAGCACTTGGACATGCTGGACGGTGGTATTATTCAGCGATTACTCGAGGAAAAATGGAAGACC
TTTGCGCGGTTGCAGTTCTTAAAACGACTGATCATCTTGGCATTCCATCTGACGTCCTTGTCGCTGGCAGTATATCT
GAGGCCTTCCAACACAGATGCTCAGCTCTTGAAATGGCCGGAAGAAATCACGGAAGTCGCACGCACGATCGCCGAGT
GCATCACGGTGCTGGGCGTGCTCAGTTACATTCTGGTCCAACTAGGCGGTGAGATCATCAACATTGGTCTCTTGTCC
TTCATGAAACAGTTGAGTCACGAGCCCGCCAAGCTCATATTCTTGATCAGCAACCTGCTCATACTCGCGTGCATTCC
ATGTCGTCTTGCCGGTAATAGGCATGCGGAAGACGCGATTCTCATAGTCGCTGTGCCCGGCTCTTGGTTCCTTCTCA
TGTTCTTCGCTGGGGCTGTCCGGCTGACCGGTCCATTCGTCACCATGGTGTACAGCATGATAACGGGAGACATGTTG
ACCTTCGGTATAATATACATGGTGGTGCTGTTCGGCTTCTGCCAGTCGTTCTACTTTTTGTACAAAGGATTCCCGGG
AGTGAAATCATCCCTCTACAGTTCCTATCACTCGACCTGGATGGCACTGTTTCAGATAACCCTCGGCGATTACAACT
ACACGGATCTCAGCTACACGACCTATCCTAATTTATCGAAGATGGTGTTCGCCATATTTATGGTACTGGTGCCTATA
CTATTGTTGAACATGCTAATCGCCATGATGGGCAACACATACGCTCATGTGATCGAGCAGAGTGAAAAGGAGTGGGT
GAAACAATGGGCTAAAATCGTGGTTTCTCTGGAACGTGCAGTCTCACAGAAGGATGCACAGAATTATTTGCAAGAAT
ATAGCATTAAACTGGGACCTGGAGATGACCCAAACAATCCTGCCGCGGAGCAGCGAGGAGTTTTGATTATTAAAAGT
AAATCGAAAACCAAGGCGAAGCAACGCAAAGGCGCGGTAGCTAATTGGAAGCGTGTGGGCAAAGTGACGATAAACGA
ATTAAAAAAACGTGGTTTAACAGGAGAGGAATTGGACGAATTATGTGGGGACGAGCTTCTTTTTCTACACCTGTCA
GAGTAAGTCCAAAAGGGGTCGAGCCTCAAGTTTCTGTGGTGACCGCCGGTTTCGGGGACGCATTGACCACAGCTTTG
GATGTCATGACGTTCGCCCACGATCTCGACTTGTCCACCGCAACGGAAGGAATTCCAACCAACATCGATGCCAAGCA
GTCGAAACCAAAGAGTGCTACCAAGGAGACGAAATCGACGGTGAATAATCAGCAGAACGTGACGACAAACATAGAAC
CATTGAAATCGACCACGGAAAATGTGGACGATCAGGCGAACAATCCTAGGGAAAAAAAGTAACTAGCCAAGCTGCG
ACCGTACACGAGATGAATTTGAAGAATGCGAATCATTCGAGCGTGACCGAGGATTTTCAGGATCCGCTTTTGGAACT
TGTGATTGCTTCCGAAAATACGAACGATCCCGAAACCCTGCTCGAAATAGCGAAACGTGCCGCGGCAGGCTTCGAAA
CAGAAACCAGCTCTAAAATAAATCTTCAAATTTTAGAACAATTCACGATGACGAAGATACCCATGGATGAGAAGGTC
AACGTTACGAGGAAACAATATTTCGTCGAATCCAGTGACAATGACTTTGGAGGCGACAACTTGCTCGGGACTGAGGC
CCGTCTACGTAGAATAAGATCAGCGAACAACAGATTTATCACGACACGTAGACGGTCACGGAAACGTCGACGACGACC
TGTCATCCACATCTTCCACGTCTATGGACAGAAATCCTCGATATCAGTCGTTGCTCAACGGCCATGAAAACTCGATC
GACCGTCCAATCGAGAGTCGAGAGTGTTCCATAGAAGCAATTAACTCGCAAATAAAGCAGAACGGACCGTGCCGAAAC
GATGAAGGCCAAGGTCCAGAAGAAAAGACCAAAAACGGCCAGAAATAGGGTATCGCCGAAGGAAATAGAGAAGGCTG
GTCCGAGGAGAAGAGAATCGATCGAGCGGAATAAGGCGGTTTCACCGGCAACATCGCCCACGGATCCGCTCGAGCCA
TGGAGCACACGCGGCATTAAGGACATGAACACGATATTGGCTTGGGAAGAGACCGCGCCGGACAGTCCTTAA
```

FIGURE 69 - SEQ ID NO: 37

```
<> 37
<> 3318
<> DNA
<> Apis florea
<> XM_003690679.1
<> ?
>gi|380013352|ref|XM_003690679.1| PREDICTED: Apis florea uncharacterized
LOC100868270 (LOC100868270), mRNA
ATGGGTGGTGTCTGCTCGTTTCGAGGTCGCGGTAGCCAGGTGAACTCTGGCTCGATCCTTGATCGTGTGATCAGTCA
AGCGAGCGACGAGGATCAATGTCTGTTGTATCGTCTGGCCAATTACAAAAAGGGTGGCGAGCTGATCGAGTCGTACA
ATCAAGGTGGCCAGTTCGAGGTAGAAAAATTGATCAGGGAACAATTCGGTGTATTGATGTATGCGAACGGTAAGGGC
CAGGTGATTAATCGTGCCGAGTATCTACGCTGGAAATTCCGAGACCTCGAGCAAGTTGTGCTCCCTATCGAAGCTTC
TTTGTCACAGTTCGACCCTTTGGCTCAATGGAACGATCACGAAGCGTGCTGGCAAATGCAGTACAGAGGTTCGCTAG
GAGAGACTCTCCTGCATGTTCTGATTATATGCGATACCAGGATACACACACGAGTGGCGCGTATTCTGCTCAAGTGC
TTTCCACGATTGGCCATTGACGTAGTCGAGGGTGAGGAGTACCTTGGCGCTAGCGCGCTCCATCTAGCGATCGCGTA
CAACAATAATGAACTGGTGCAAGACCTCGTTGAGGCGGGAGCGATCATTTCTCAGCGGGCGATAGGCAGCTTTTTCC
TACCCAGGGACCAACAACGAATGAATCCGGCTAAGAATACGGATTACGAGGGATTAGCTTATCTGGGGGAATATCCC
CTCGCCTGGGCCGCTTGTTGTGCAAACGAGAGCGTTTACAACTTATTACTCGACTCTGGCGCTGATCCCGACGAGCA
AGACTCTTTCGGAAACATGATACTGCATATGGTAGTGGTTTGTGATAAATTGGACATGTTCGGATATGCTCTCCGTC
ATCCGAAGCTTCCTGCTCGCAATGGGATTGTGAATGCTGCCGGACTGACCCCATTGACGCTCGCCTGCCAGTTGGGC
CGTGCTGAAGTCTTTCGGGAGATGTTGGAACTGTCCGCACGAGAATTCTGGCGCTACAGTAACATCACCTGCTCGGC
ATATCCCCTGAATGCGCTCGATACGCTGTTGCCCGATGGTAGAACAAACTGGAACTCGGCGCTATTTATCATTCTGA
ACGGTACGAAGGAGGAGCACTTGGACATGCTGGACGGTGGTATTATTCAGCGATTACTCGAGGAAAAATGGAAGACC
TTTGCGCGGTTGCAGTTTTTAAAACGACTAATCATCTTGGCATTCCATCTGACGTCCTTGTCGCTGGCAGTGTACCT
GAGACCTTCCAACACAGATGCTCAACTCTTGAAATGGCCGGAAGAAATCACGGAAGTCGCACGCACGATCGCCGAGT
GCATCACGGTGCTAGGCGTGCTCAGTTATATTCTGGTCCAACTAGGTGGCGAGATCATCAACATTGGTCTCCTGTCC
TTCATGAAACAGTTGAGTCACGAGCCCGCCAAGCTCATATTCTTGATCAGCAACCTGCTCATACTCGCGTGCATTCC
ATGTCGTCTTGCCGGTAATAGGCATGCGGAAGACGCGATACTCATAGTCGCTGTGCCCGGCTCTTGGTTCCTTCTCA
TGTTCTTCGCTGGGGCTGTCCGGCTGACCGGTCCATTCGTCACCATGGTGTATAGCATGATAACGGGAGACATGTTG
ACCTTCGGTATAATATACATGGTGGTACTGTTCGGCTTCTGTCAGTCGTTCTACTTTTTGTACAAAGGATTCCCGGG
AGTGAAATCATCCCTCTACAGTTCCTATCACTCGACCTGGATGGCACTGTTTCAGATAACCCTCGGCGATTACAACT
ACACGGATCTCAGCTACACGACCTATCCTAATTTATCGAAGATGGTGTTCGCTATATTTATGGTACTGGTGCCTATA
CTATTGTTGAACATGCTAATCGCCATGATGGGCAACACGTATGCCCACGTGATTGAGCAGAGTGAAAAGGAATGGGT
GAAACAATGGGCGAAAATCGTGGTTTCTCTGGAACGTGCAGTTTCACAGAAGGATGCACAGAATTATTTGCAAGAAT
ATAGCATTAAACTGGGACCTGGAGATGACCCAAACAATCCTGCCTCGGAGCAACGAGGAGTCTTGATTATTAAAAGT
AAATCGAAACCAAGGCGAAGCAACGCAAAGGCGCGGTGGCTAATTGGAAGCGTGTGGGCAAGGTGACGATAAATGA
ATTAAAGAAACGTGGCTTAACAGGAGAGGAATTGCGACGAATTATGTGGGGTCGAGCTTCTTTTTCTACACCTGTAA
GAGTAAGTCCAAAAGGGGGTCGAGGCCTCAAGTTTCTGTGGTGACTGCCGGTTTCGGAGACGCGTTGACCACAGCTTTG
GATGTCATGGCGTTCGCCCATGATCTCGACTTGTCTACCGCAACGGAAGGAATTCCAACCAACATCGATGCCAAGCA
GTCGAAACCGAAGAGTGCTATCAAGGAGCAGATGAAATTGACGACGAATAATCAGGAGAACGTGTCGACTAACGTAG
AACCGCAGCTGAAATCGACCACGGAAAATGCGAACGATCAGGCGAACAATCCTAGGGAAATTAAAAAAGTAACTAAC
CAGGTTACAGGCATACACGAGATGAATTTGAAGAACGCGAATCATTCGAGCGTGACCGAGGATTTTCAGGATCCACT
TTTGGAACTTGTGATTGCTTCCGAAAATACGAACGATCCCGAAACCCTGCTCGAAATAGCGAAACGTGCCGCGGCAG
GCTTCGAAACAGAAGCCAGCTCTAAAATAAATCTTCAAATTTTAGAACAATTCACGATGACGAAGATACCTATGGAG
GAGAAGGTCAGCGTTACAAGGAAACAATATTTCGTCGAGTCTAGTGACAATGACTTTGGAGGCGACAACCTGCTCGG
GACTGAGGCCCGTCTACGTAGAATAAGATCAGCGAACAACAGATTTATCACGACACGTAGACGGTCACGGAACGTCG
ACGACGACCTGTCATCCACATCTTCCACGTCCATGACACGAAATCCTCGATATCAGTCGTTGTTCAACGGCCATGAA
AACTCGATCGACCGTCCAATCGAGAGTCGAGAGTGTTCCATGGAAGCAATTAACTCGCAAATAAAGCAGAACGGGCC
ACCGTGCGAAACAGTGAAGGCCAAGGTCCAGAAGAAAAGACCAAAAACGGCCAAAAATAGGGTATCGCCGAAGGAAA
TAGAGAAGGCTGGTCCGAGGAGAAGAGAATCGATCGAGCGGAATAAGGCGGTTTCACCGGCAACATCGCCCACGGAT
CCGCTCGAGCCATGGAGCACACGCGGCATTAAGGACATGAACACGATATTGGCTTGGGAAGAGACCGCGCCGGACAG
TCCTTAA
```

FIGURE 70 - SEQ ID NO: 38

<> 38
<> 3168
<> DNA
<> Pediculus humanus corporis
<> XM_002432337.1
<> ?
>gi|242023926|ref|XM_002432337.1| Pediculus humanus corporis conserved
hypothetical protein, mRNA
ATGGGAGCTGGATTATGTGGAACTTCTCAAGATCCTCAAAATCAAGGTTCGGTTTTGGATAGAGTCATTTCTCAAGC
TTCTAACAAAGATGATTGTCTTTTATATAAACTTGCCAACTACAAAAACAGTGGAGAATTGATCGAAGCATACAATA
TTGGAGGTCAAGCTGAGGTTGAAAAACTGATTAAAGAACAATTTGGAGTTTTAATGTATGCCGATGGCAAAGGTGAA
GTAATTAAACGTGCAGAATACCTTAGGTGGAAATTTCGAGATCAAGCTCAGGTCGTTTTACCTATCGAAGCTTCTTT
ATCTATTTACGATCCTTTGGCAAAATGGGAAGACCACGAAGCTTGTTGGCAAATGCAGTACAGGGGTAGTTTAGGAG
AAACGCTTCTTCATGTTTTGATAATTTGCGATTCTAAAATACACACAAAACTTGCTCGTACCCTTTTAAAATGCTTT
CCTAAACTTGCTTTGGATATAGTAGAAGGAGAAGAATATTTGGGAGCTAGTGCTCTTCATTTAGCCATTGCTTATAA
TAATAACGAATTAGTTGAAGATTTGGTAGATGCTGGAGCCAACATTAATCAAAGAGCAGTAGGTAGTTTTTTTCTTC
CTAAAGATCAACAACGAGCAAAACCTTTAAAAACCACAGATTACGAAGGTTTGGCATATTTAGGAGAATATCCTTTA
TCGTGGGCAGCTTGCTGCTCGAATGAAAGCGTCTACAATTTACTTCTTGATGTCGGTGCCGATCCTGACAGTCAGGA
TTCTTTTGGAAATATGATATTGCACATGGTGGTCGTTTGTGATAAACTGGACATGTTTGGTTATGCTCTTCGTCATC
CAAAAGTACCAGCTAGTAATGGAATAATTAACAACGAGGGACTTACTCCCCTAACATTGGCATGTAAATTGGGTAGA
GCAGATGTTTTTAAAGAAATGTTAGAACTGAGTGCTAAAGAATTTTGGCGTTACAGCAACATCACTTGTTCGGCATA
TCCACTAAATGCACTTGACACTCTATTACCAGATGGAAGAACCAATTGGAATTCTGCAATTTTTATTATTTTAAACG
GTACCAAAGAAGAACATTTAGACATGTTAGATGGTGGAATAATCCAAAGGCTTTTGGAAGAAAAATGGAAAACTTTT
GCAAGAAACCAATTTTTAAAACGTTTGGTTATTTTCTTCTTACATATATTTTGCCTAAGTGGTTCTGTATATTTAAG
ACCGGACGATAGAAATAAACCACTTTTGGGTGGTACTTCCGTTCAAGATGTTGTCAGGTATTGTTTCGAAATCGGTA
CCATACTCGGAGTTCTTTGTTATTTATGTTTTCAACAAGGAGATGAAATTAGAAATCAAGGATTGATTAGTTTTTTA
AAACAATTGCCGCATGATCCTGCAAAGTTTATATTTCTCATATCAAATCTTTTAATTTTGGCCTGTATACCTTACCG
TGTGGCTGGTGTGATACGGATACGGAAGAAGCCATACTTGTATTTGCGGTACCTAGTTCGTGGTTTCTGTTAATGTTTT
TTGCCGGAGCGATTCGATTAACTGGTCCATTTGTCACCATGATTTACAGTATGATCACTGGAGATATGTTAACCTTT
GGTATTATATATTCGGTATTTTTATTTGGTTTTTCTCAAAGTTTTTTTTTCCTATACAAAGGCTCTAAAAATGTGAG
CAGTTCTCTATTTACTTCATATCCATCAACTTGGATGGCTCTTTTTCAAGTCACAATGGGAGATTATAACTACAATG
ATTTATCTCTAACAGCATATCCAGCCATTAGCAAAATGGTATTCACAATATTTATGGTTTTGGTACCCATTCTTTTG
TTAAACATGTTGATTGCCATGATGGGCAATACTTATGCTCATGTTATTGAACAAAGCGAAAAGAATGGATGAAACA
GTGGGCTAAAATTGTTGTGGCTTTGGAACGTGCGGTAAATCAGGAAGATTGTCATCGTTACTTACAAGAATATTCTA
TTAAATTAGGTCCTGGTGATGATCCTAGCACCGAGCAAAGAGGTGTTTTGGTAATTAAATCTAAAAGTAAAACAAGA
GCAAAACAAAGAAAAGGCGCACTTTGTAATTGGAAGAGGGTTGGAAAAGTAACCATTCGAGAATTGCATAAGAGAGG
AATGACCGGAGAACAATTGCGACGTCTTATGTGGGGAAGATCATCAATTTCAACCCCCGTCAAACCTGCACCAATAA
AATTAGGCCACGTTACGAGCATCTCGGGTGTGGCTGATATAACCGTTCCAGAAACGACAGGAAACACTGTTGGAACG
GGAGGAGGCGGTTTGTTAGCTGCTTTGGACGTTATGGCATTTACAAATGATTTGGAATTCAGTTCGGAAAATCAAAC
TTCGACCAGTTTCAAAACTCAACCTCAACCATCAGAAGTTTCTTGCGTTGAATCGGATTCGAATTCAGATCCTTTAT
ATAATGATCCTCTGAGGCAATTGAATGAAGAACTCAATAAAACTCGGGAAGAAATTTTAACTTTAGCTCGAGTTGCA
GCAAATAATGATGGAATTGAAGAGATACCACCGCAAATATGTCAATACGGTTGGATTAATAATTATAATTTTTTCGG
TAATACATTTGCACAAAATCAAAAAGTTGAGGATCCTGTTCAACAGCCTACATTTCAATCTACACCAAATCATAGCG
ACAGTGATGGTTTAGGAGATGGATTACTCCTTGGAAGTAATCGAAGATTAAAAAGAACTCGATCGGCAAATATAAAA
AGAAAGTTTTCTGGAAGTTCGACAAATGAAAAAAATTTATTAGAACCTGAGGATTCAAGTTCAACTAATTCCGAGGA
TTTTTCATGTTTAACCGAAAATTACATAAATAAAATATTAAAGTTAATGCAAATTTTTCGGAGAATTCTTTACGAA
GTAATAGAAGTTCTGCCAATCTCGTGGTGAAAAAATTTGGAAGAAGGTCGGGTTTGAAATCCTCTACCAACAGAATT
GCTCCTGCTGATTTAAGTCCAGTTGGTAATGTTTCCAAATACTCTGAAACTTTGTGTAACTCATATTGTATTACTTC
TTCATCGGATGTTTTGTATCAATGGAGTATAAAAGGAATAACAAATATGAATACACTTTTAGGATTGGAAAATGAGG
ATTCAATGTAA

FIGURE 71 - SEQ ID NO: 39

<> 39
<> 3330
<> DNA
<> Acromyrmex echinatior
<> gi|332020355
<> ?
>(gi|332020355:c165202-164378, c163792-163567, c156295-156180, c153678-
153442, c150494-150343, c142816-142600, c141823-141662, c140745-140548,
c140090-139981, c138782-138433, c138023-137772, c137679-137370, c136361-
136187) Acromyrmex echinatior unplaced genomic scaffold scaffold532, whole
genome shotgun sequence
ATGGGTGGTGTTTGCTCGTGCCGCGTTGGTCGCAACAGCCAGGTCAACGCCGGTTCGATCCTCGACCGCGTGATCAG
CCAGGCAAGCAACGAGGACCAGTGTTTATTGTATCGATTGGCGAACTACAAGAAGGGCGGTGAGCTAATCGAGGCGT
ACAACCAGGGCGGTCAGCCTGAGGTGGAGAAGCTGATCCGCGAGCAATTTGGTATCCTGATGTATATGGATGGCAAA
GGCCAGATAATCAATCGTGCCGAGTATCTACGTTGGAAATTTCGTGACCTCGAGCAAGTCGTGTTGCCGATCGAGGC
CTCGCTGTCGCGTTTTGATCCACTAGCGCAGTGGAATGATCATGAAGCCTGCTGGCAGATGCAGTACAGAGGCTCGC
TGGGCGAGACCTTGTTGCATGTTCTTATCATATGTGACACGCGGATGCATACTAGAATAGCGCGCATACTGCTCAAG
TGTTTTCCGCGGCTAGCTATTGACGTCGTCGAGGGCGAAGAGTATCTGGGTGCGAGTGCTCTTCATCTGGCGATCGC
CTATGCGAACAACGAGCTCGTGCAGGATCTGGTCGAGGCGGGCGCGATTATCTCGCAGCGGGCCATCGGTAGCTTCT
TCCTGCCGCGGGATCAGCAAAGGATGAATCCCGCCAGAAATACCGATTACGAGGGTCTCGCGTATCTGGGAGAGTAT
CCTCTCGCCTGGGCCGCCTGCTGCGCTAATGAGAGCGTCTACAACCTGCTGCTTGATTCCGGCGCTGATCCTGACGA
GCAGGATACTTTTGGAAATATGATTTTGCACATGGTCGTAGTTTGCGACAAATTGGACATGTTCGGCTACGCATTGC
GACATCCGAAGCTTCCTGCTCGCAATGGAATTGTGAATGCCGCGGGCCTGACCCCGTTGACACTCGCCTGCCAGCTG
GGGCGTGCCGAGGTCTTCCGTGAGATGTTGGAGCTGTCCGCGCGGGAGTTTTGGCGTTACAGTAATATCACTTGCTC
GGCGTACCCTCTCAATGCTCTCGACACGCTGTTGCCCGATGGCAGAACAAACTGGAACTCTGCGCTATTTATCATTC
TGAACGGTACGAAGGAGGAGCACTTGGACATGCTGGACGGTGGTATTATTCAGCGATTACTTGAGGAAAAATGGAAG
ACCTTCGCGCGATTGCAGTTCCTGAAGCGATTGATTATCTTGGTGTTTCACCTGGCCTCGCTGTCCTTAGCCATGTA
CTTCAGGCCCGCGGACATGGAGGCTGTGCTGCTGCAGTGGCCCGAGGAGATAACGGACGTCGTCCGCACCGCGGCGG
AGTGCATCACCGTGCTGGGCGTGCTGAATTACATCCTGGTGCAGCTGGGATGCGAAATGATCAACGTCGGTCCGCTA
TCATTCCTGAAGCAACTGAGCCACGAACCGGCCAAGTTGATATTCGTGATCAGCAATCTGCTCATTCTCGCGTGCAT
TCCATGTCGTATCGCTGGCGATCGGCACGCGGAGGATGCGATACTGATGTTCGCTGTGCCGGGCTCATGGTTTCTTC
TTATGTTTTTCGCCGGAGCGATTCGATTGACTGGTCCATTTGTCACAATGGTATACAGCATGATAACGGGCGATATG
CTGACCTTTGGTATTATCTACACGGTTATGCTCTTTGGATTCTCGCAATCATTTTACTTTCTTTATAAGGGATTCCC
CGGAGTGAAATCATCTCTGTATCATTCCTATCCTTCGACCTGGATGGCACTGTTTCAGATAACCCTCGGCGATTATA
ACTACGCGGATTTGAGTAACACGACCTATCCTAACTTGAGCAAGACCGTCTTTGCGATTTTCATGGTACTTGTGCCC
ATACTGCTGCTCAACATGCTAATTGCCATGATGGTAATACATATGCACATGTTATCGAGCAAAGCGAAAAGGAATT
CGTCAAGCAGTGGGCAAAAATCGTGGTGTCTTTGGAACGCGCCGTATCTCAGAAAGATGCTCATAATTACCTACAGG
AATACAGCATTAAACTGGGACCCGGCGATGATCCGAACAACCCCGCGTCGGAACAAAGGGGCGTGTTGGTTATTAAA
AGTAAATCGAAAACCAGAGCAAAGCAGCGTAAGGGCGCTGTGTCTAATTGGAAGCGAGTCGGAAAAGTCACGATACT
CGAATTGAGAAAACGAGGTATGACTGGCGAGGAACTCCGTCGTATAATGTGGGGTCGCGCGTCCTTTTCCACCCCTG
TGCGAGTCAGTCCCAATGCCGGTCAACCGCAAGTGTCGGCAGTTACTGCAGGTTTTGATGATGCGTTAACCGCAGCT
TTGGACGTAATGGCCTTTGCACATGACTTTGACTTATCCACTGCGACGGAAGGCATACCTACCAATATCGACGCAAA
ACAGATAAAGACAGCGCAGTCGAAAGCCGCTCTCAACGACCAGCAGACGAAAACAACCCAAAATAATCCAGAAGTGG
TGATAAATGTGCAACCGCATAATCAACCCATTAAAGAGGAAACTAAATTATCAGGTCTCACAGATTTAATCGATAAG
TCTATCGATCCCGTAAAGGATGTGGAGGCAATGAATTTGAGAAATATGAATCAAACGAAAGCGCTCGAAGAAACCGT
CGAAGATCCATTTTTGGAACTCGCTATCGCTTCTGAGACTACAACGGATTACAAAACTCTACTGCAAATAGCGAAGT
CCGCTTTAGCCACAAGCGAAGCTTCAATGAAAACCACAATCGACCCGCAAATTCTAGCACACTTCGCCATGGTCGCG
CCGCCGACCATTGAGAAATCTTCTATCGTTAAGAAACAGTATTTCATGGAGTCCAGCGACAATGACCTCGGCGGCGA
TAATTTACTTGGCACCGAAGCTCGCCTTCGAAGGATAAAATCCGCGAATAACAGATTCACTACATCGAAACGGTCAC
GCCGTGATGACGATGGCGACAGTTCCTCATCTACAACATCCGTCGAACAAAGTCTGCGATATCGACCACTACTGAAT
GATCCGGAACAGAGACCGATGAATCGTATCGAGACTGAAGGACGAAAGACCACCGTGGAAACAATTAAGCCGGAGGT
CAAACAGAATGGCAGCATTCCTACCAAACCACTCGATAAAATCCAAAAACGTCGACCAAAAACGGCCAAGAATAGGG
TATCGCCTAAAGAAACTGAGGAACCAGCGAGGAGAAGGGAATCGATTGAGCGGAATAAGGCGGCTTCACCACCTACG
TCGTCCTCGGATCCGCTCGAGCCATGGAGCACGCGTGGCATTACCGACATGAACACAATATTGGCTTGGCGGGAAAA
CGCACCGGACAGTCCTTAA

FIGURE 72 - SEQ ID NO: 40

<> 40
<> 3339
<> DNA
<> Harpegnathos saltator
<> gi|307206889
<> ?
>(gi|307206889:1112686-1113507, 1113778-1114003, 1120594-1120709, 1123877-
1124113, 1127231-1127382, 1135454-1135670, 1136818-1136979, 1137310-1137507,
1138165-1138274, 1139575-1139909, 1140105-1140350, 1140588-1140924, 1141746-
1141926) Harpegnathos saltator unplaced genomic scaffold scaffold219, whole
genome shotgun sequence
ATGGGTGGTGTTTGCTCGTGTCGCGGCCGCGGCAGCCAGGTCAACGCCGGCTCGATCCTCGACCGCGTGATCAGCCA
GGCGAGCAACGAGGACCAGTGTTTGTTGTATCGGCTGGCCAACTACAAGAAGGGCGGCGAGCTGATAGAGGCTTACA
ACCAGGGCGGCCAGCCGGAGGTCGAGAGACTGATAAGAGAGCAATTCGGCATCCTGATGTACGCGGACGGCAAGGGT
CAGGTGATCAATCGCGCCGAGTATCTACGCTGGAAGTTTCGCGACCTGGAGCAGGTCGTGCTGCCGATCGAGGCGTC
GTTGTCGCGCTTCGACCCGTTGGCACAGTGGTACGACCACGAAGCCTGCTGGCAGATGCAGTACAGAGGCTCGCTGG
GAGAGAGCCTGCTGCACGTGCTCATCATATGCGACACGCGTATGCACACGGGATAGCGCGCACGTTGCTCAAGTGC
TTCCCACGGCTGGCCATCGACGTGGTCGAGGGCGAGGAATACCTCGGCGCTAGTGCCCTTCATCTGGCGATCGCCTA
CAACAACAACGAGCTCGTGCAGGATCTGGTCGAGGCGGGCGCGATCATCTCGCAACGGGCTATCGGCAGCTTCTTCC
TGCCCAGAGACCAGCAGAGGATGAATCCCGTAAGGAACACCGATTACGAGGGACTCGCGTATCTCGGGGAGTACCCG
CTCGCGTGGGCCGCGTGCTGCGCCAACGAAAGCGTTTACAACCTGCTGCTCGACTCCGGCGCCGATCCTGACGAGCA
GGATTCTTTCGGAAATATGATTTTGCACATGGTTGTAGTGTGCGACAAATTGGACATGTTCGGCTATGCCCTGCGAC
ATCCCAAGCTTCCCACTCGCAACGGAATCGTGAATGCCGCAGGCCTGACCCCATTGACACTCGCCTGCCAGCTGGGG
CGTGCCGAGGTCTTCCGTGAGATGCTGGAGCTGTCCGCACGGGAGTTCTGGCGTTACAGTAATATCACCTGCTCGGC
GTATCCACTCAATGCTCTCGACACGCTGCTCCCGGACGGTAGAACAAACTGGAACTCTGCGCTATTTATCATTCTGA
ACGGTACGAAGGAGGAGCACTTGGACATGCTGGACGGTGGTGTTATTCAGCGATTACTTGAGGAAAAATGGAAGACC
TTTGCGCGATTGCAGTTCCTGAAGCGATTGATTATCTTGGTGTTTCACCTGGCCTCGCTGTCCTTAGCCGTGTACTT
CAGGCCCGCGGACATGGACGCCGAGTTGCTGCAGTGGCCCGACGAGATTACGGACGCCGCCCGCATCGCGGCGGAAT
GCAGTACCGTGCTGGGTGTGCTAAGTTACATCCTGGTGCAACTGGGCGGCGAGATGATCAACATCGGTCCGCTGTCG
TTCCTGAAGCAACTGAGCCACGAACCGGCCAAGTTGATATTCGTGATCAGCAATCTGCTCATTCTCGCGTGCATTCC
ATGTCGTATCGCCGGCAATCGGCACGCGGAGGATGCGATACTGGTGTTCGCCGTGCCGGGCTCGTGGTTTCTTCTCA
TGTTTTTCGCCGGAGCTATCCGACTGACCGGTCCGTTCGTCACGATGGTGTACAGCATGATAACCGGCGACATGCTG
ACCTTCGGCATCATTTACACGGTCATGCTCTTTGGATTTTCTCAATCGTTTTATTTCCTCTACAAGGGATTCCCGGG
CGTGAAGTCGTCCCTCTACCATTCCTATCCTTCGACCTGGATGGCGTTATTTCAGATAACCTTGGGCGATTATAACT
ACGCAGACCTAAGTAACACGACCTATCCCAACTTGAGTAAGACGGTCTTTGCGATCTTCATGGTGCTCGTGCCGATA
TTGCTGCTCAATATGCTGATCGCCATGATGGGTAATACGTACGCGCACGTTATCGAGCAGAGCGAGAAGGAATTTGT
GAAGCAGTGGGCCAAAATTGTGGTATCTTTGGAACGCGCTGTGTCGCAGAAGGACGCCCATAATTATCTACAGGAAT
ACAGTATCAAGTTGGGGCCGGGCGACGATCCGAATAATCCCGCATCGGACGAGAGAGGTGTGCTGATTATTAAAAGC
AAATCGAAAACTAGAGCGAAACAGCGCAAGGGCGCCGTGGCTAATTGGAAGCGAGTCGGAAAAGTCACGATAAACGA
GCTGAGAAAACGAGGTATGACTGGCGAGGAGCTACGCCGTATAATGTGGGATCGTGCGTCCATCTCCACTCCTGTGC
GAGTCAGTCCTAATGTCAACGAGCCACAAGTGTCGGCAGTTACTGCAGGTTTTGGTGACGCGCTAACCGCAGCTTTG
GACGTAATGGCCTTTGCGCACGACTTTGACTTATCCACTGCGACGGAAGGCGTACCGAGCAATATCGACACGAGGCA
GACGAAAGCCATCCCCGACGAGCAGACGAGAACGGCTCGGAATAATCCAAAGGCGGTGACGGATGTCCAACCGCACA
AACAAGCCATCGGGGGGAGGAGACCAAGTTGTCAGGTCTCACGGATCTAATTGATATGTCCGCCGCCGAACCGGCG
CGCGTGGAAGCGATGAACTTGAAGAACGCGAGTCAAGCAAAGGCGCACGAGGGAGCTGTCGAGGATCCATTCCTGGA
GCTCGCTATCGCCTCCGAGACTACGGAAGATTACGATACTTTATTGCAAATGGCCAAGTCCGCCCTAGCTACCAGTG
AGGCTTCAACCACGGTCGACCCACAAATTCTAGCACACTTCACTATGATCGCCCCGCCGCCCGTTGAAAAACCCATC
GTTGTTAAGAAACAATACTTGGTGGAGTCCAGTGACAACGATCTCGGTGGCGACAATTTGCTCGGTACCGAAGCTCG
CATCAGGAGGATAAAGTCGGCGAATGATAGATTCATCAGCACATCCAAACGATCACACCATGACGACGATAACGACA
GTTCCTCGTCCGTCACTTCCGTCGACCGGAGTCAGCCGCAGTATCGACCGCTGCTGAATGATTCGGAAGAGAGCCTG
GCGAACCGCGTCGAGAACGAAGGACGAAGAACTTCCGACGTCGAAACAATTAAGTCGGAAGTCAAGCAGAACGGCCG
CGGCGGCGGCGGCGGTGTTTCCAAGCCGTCGGATAAACGCGTCCAGAAACGCCGGCCGAAAACGGCCAAGAACA
GGGTATCGCCTAAGGAAATAGAGGAACCGGCGAGGAGACGAGAAGAATCGATTGAGCGGAATAAGGCGGCTCTTTCA
CCTCCGGCGTCGCCCTCGGATCCGCTCGAGCCATGGAGCACGCGTGGCATTACCGACATGAACACGATATTGGCCTG
GCGGGAGAATGCACCGGACAGTCCTTAA

FIGURE 73 - SEQ ID NO: 41

<> 41
<> 3315
<> DNA
<> Bombus impatiens
<> XM_003485651.1
<> ?
>gi|350399982|ref|XM_003485651.1| PREDICTED: Bombus impatiens hypothetical
protein LOC100747394, transcript variant 1 (LOC100747394), mRNA
ATGGGTGGTGTCTGCTCGTGTCGAGGTCGCGGTAGCCAGGTGAATGCTGGCTCGATCCTTGATCGAGTGATCAGTCA
TGCGAGCGACGAGGATCAATGTCTATTGTATCGTCTGGCCAATTATAAGAAGGGCGGCGAGCTGATCGAGTCGTACA
ATCAAGGTGGCCAAGCGGAAGTGGAAAAATTGATCAGGGAACAGTTCGGTGTACTGATGTACGCAGATGGGAAGGGT
CAGGCGATCAATCGGGCGGAATATCTACGTTGGAAATTCCGTGACCTCGAGCAGGTTGTGCTACCAATAGAGGCTTC
TTTGTCACAGTTTGATCCTCTGGCTCAATGGAACGATCATGAAGCATGTTGGCAGATGCAATATAGAGGATCACTCG
GAGAGACTCTCCTGCATGTCCTGATTATATGCGATACCAGGATACACACACGACTAGCGCGTATTCTGCTTAAGTGC
TTTCCACGATTGGCTATTGACGTAGTCGAGGGCGAGGAGTACCTCGGCGCTAGCGCTCTGCATCTCGCTATCGCGTA
CAACAATAATGAACTGGTTCAAGATCTCGTGGAGGCGGGAGCGATTATTTCTCAGAGGGCGATAGGCAGCTTTTTCC
TGCCTAGGGACCAACAACGAACGAATCCAGCTAAGAATACGGATTACGAGGGATTAGCATACCTGGGAGAGTATCCC
CTCGCCTGGGCTGCTTGCTGTGCAAACGAGAGTGTTTACAACTTATTACTCGACTCTGGCGCTGATCCCGACGAGCA
GGACTCTTTTGGGAACATGATACTACATATGGTAGTCGTTTGTGATAAATTGGACATGTTCGGGTATGCCCTCCGTC
ATCCGAAGCTTCCTGCTCGCAATGGGATCGTGAATGCCGCCGGACTGACCCCATTGACGCTCGCCTGCCAGCTGGGT
CGCGCAGAGGTCTTTCGGGAGATGTTGGAACTGTCTGCACGAGAATTCTGGCGTTACAGTAATATCACCTGCTCGGC
ATATCCGCTGAATGCACTCGACACGCTGTTACCTGACGGCAGAACAAACTGGAACTCCGCGCTATTTATCATTCTGA
ACGGTACGAAGGAGGAGCACTTGGACATGCTGGACGGTGGTATTATTCAGCGATTACTCGAGGAAAAATGGAAGACC
TTTGCGCGGTTGCAGTTCTTGAAACGGTTGATCATCCTGGTGTTCCATCTGACATCACTCTCGCTAGCCGTGTATAT
GAGACCGTCAAACATCGATGCCACCCTCCTGGAATGGCCGGAAGAAATCACGGAAGTTGGACGCATGATCGCGGAGT
GCACCACGGTAATAGGTGTGCTGAGCTACATTTTGGTGCAACTAGGCGGCGAGGTAGTCAACATTGGTCTTCTATCG
TTCATGAAACAATTGAGTCACGAGCCTGCCAAGCTCATATTCTTGATCAGCAATCTGCTCATACTCGCGTGCATACC
ATGTCGTCTTGCTGGTAATAGGCATGCTGAAGACGCGATACTCGTGGTTGCTGTTCCCGGCTCTTGGTTCCTCCTCA
TGTTCTTTGCTGGCGCTATCCGGTTGACCGGTCCATTCGTTACCATGGTCTACAGTATGATAACCGGTGACATGTTG
ACCTTCGGGATAATCTACATGGTGGTGCTGTTCGGATTTTGCCAGTCGTTCTACTTTTTGTACAAAGGCTTCCCGGG
AGTGAAATCATCCCTCTACAGTTCCTATCACTCGACCTGGATGGCACTGTTTCAGATAACCCTCGGCGATTATAACT
ATACGGACCTCGGCTACACAACCTACCCTAATTTATCGAAGATGGTGTTCGCCATATTTATGGTCCTGGTGCCCATA
CTGCTGTTGAATATGCTGATTGCGATGATGGGCAACACTTACGCGCATGTGATCGAGCAGAGCGAGAAGGAATGGGT
GAAGCAATGGGCGAAAATCGTGGTTTCTCTGGAGCGTGCAGTCGCGCAGAAAGATGCGCAGAATTATTTGCAAGAAT
ACAGTATTAAACTGGGACCTGGAGATGACCCGAACAACCCCGCCTCGGAACAGCGCGGAGTCCTGATTATTAAAAGT
AAATCGAAAACCAAGGCGAAGCAACGCAAAGGCGCGGTGGCTAATTGAAGCGCGTAGGCAAAGTGACGATAAACGA
ATTGAAGAAACGTGGTATAACAGGAGAGGCGTTGCGACGAGTCATGTGGGGCCGAGCATCTTTCTCCACTCCTGTTA
GAACGAGTCCAAACACTGCCGAGCCTCAAGTTTCAGCGGTTACGGCCGGTTTTGGAGACGCATTGACTGCAGCGCTG
GATGTGATGGCGTTCGCCCACGATCTCGACTTGTCTACTGCTACGGAAGGAATTCCGACCAACATCGGCGCGAAGCA
GTCGAAATCGAAGACCGCCTGCAAGGATCAAGCGAAATCGGCGACGAATAATCAGGAGAAAGGGTCGACGGACGTTC
AGCAACAACGGAAACTAACCACGGAAAATCTGGATAATCTGGCGAGCAGTCATAATGATATTGACAAAACATCCAGC
GAATTTGTGGCCGTTCGCGGAGATGAATTCGAAGAACGCGAGTCATTCGAGCATGGCCGAGGATTTTCAGGATCCGCT
TTTGGAGCTTGTGATTGCTTCCGAAAATACGGACGATCCTGAAACGCTGCTGAAAATAGCGGAGCGGGCCGCAGCGA
ATTTCGAAGTGGAGAGCAGTTCGAAAATAAATCTGCAAATTTTGGAGCAATTCACGATGACTAAGCTACCTATGGAG
GAGAAAGTTGCCGCTACAAAGAAGCAGTACTTTGTTGAATCGAGTGACAACGATTTTGGTGGCGACAACCTACTCGG
AACCGAGGCCCGTCTACGTAGAATAAGATCAGCGAACAACAGATTTATCACGACACGGAGACGGTCGCGGCACACCG
ATGACGACCTGTCATCTACGTCGTCCACATCCGCCGACAGAAATCCTCAATATCAGCCATTGCTCAACGGCCCTGAG
AACTTGGCGAGCCGTCAAATCGAAAGTCGAGAGAGCTCTATCGAAGCAATTAAGCCGCAAGTAAAGCAGAACGGGTC
ATGCGATTCAGTGAAGATCAAGGTTCAGAAGCGTCGACCGAAAACGGCGAAAAATAGGGTATCACCGAAGGAAATAG
AGGAGGCTGGTCCGAGGAGAAGAGAATCGATCGAGCGGAATAAGGCGGTTTCGCCGGCGACGTCGCCTACTGATCCG
CTCGAACCATGGAGCACACGCGGCATTAAGGACATGAACACGATATTGGCTTGGGAGGAGAATACGCCGGACAGTCC
TTAA

FIGURE 74 - SEQ ID NO: 42

<> 42
<> 3075
<> DNA
<> Bombus terrestris
<> XM_003396143.1
<> ?
>gi|340715376|ref|XM_003396143.1| PREDICTED: Bombus terrestris transient
receptor potential cation channel subfamily V member 6-like (LOC100648205),
mRNA
ATGGGTGGTGTCTGCTCGTGTCGAGGTCGCGGTAGCCAGGTGAATGCTGGCTCGATCCTTGATCGAGTGATCAGTCA
TGCAAGCGACGAGGATCAATGTCTATTGTATCGTCTGGCCAATTACAAGAAGGGTGGCGAGCTGATCGAGTCGTACA
ATCAAGGTGGCCAAGCGGAAGTGGAAAAATTGATCAGGGAACAGTTCGGTGTACTGATGTACGCAGATGGGAAGGGT
CAGGCGATCAATCGGGCGGAATATCTACGTTGGAAATTCCGTGACCTCGAGCAGGTTGTGCTGCCAATAGAGGCTTC
TTTGTCACAGTTCGATCCTCTAGCTCAATGGAACGATCATGAAGCATGTTGGCAGATGCAATATAGAGGATCACTCG
GAGAGACTCTCCTGCATGTCCTGATTATATGCGATACCAGGATACACACACGACTAGCGCGTATTCTGCTTAAGTGC
TTTCCACGATTGGCTATTGACGTAGTCGAGGGCGAGGAGTACCTCGGCGCTAGCGCTCTGCATCTCGCTATCGCGTA
CAACAATAATGAACTGGTTCAAGATCTCGTGGAGGCGGGCGCGATTATTTCTCAGAGGGCGATAGGCAGCTTTTTCC
TGCCTAGGGACCAACAACGAACGAATCCAGCTAAGAATACGGATTACGAGGGATTAGCATACCTGGGAGAGTATCCC
CTCGCCTGGGCTGCTTGCTGTGCAAACGAGAGTGTTTACAACTTATTACTCGACTCTGGCGCTGATCCCGACGAGCA
GGACTCTTTTGGGAACATGATACTACATATGGTAGTCGTTTGTGATAAATTGGACATGTTCGGGTATGCCCTCCGTC
ATCCGAAGCTTCCTGCTCGCAATGGGATCGTGAATGCCGCCGGACTGACCCCATTGACGCTCGCCTGCCAGCTGGGT
CGCGCAGAGGTCTTTCGGGAGATGTTGGAACTGTCTGCACGAGAATTCTGGCGTTACAGTAATATCACCTGCTCGGC
ATATCCGCTGAATGCACTCGACACGCTGTTACCTGACGGCAGAACAAACTGGAACTCCGCGCTATTTATCATTCTGA
ACGGTACGAAGGAGGAGCACTTGGACATGCTGGACGGTGGTATTATTCAGCGATTACTCGAGGAAAAATGGAAGACC
TTTGCGCGGTTGCAGTTCTTGAAACGGTTGATCATCCTGGTGTTCCATCTGACATCACTCTCGCTAGCCGTGTATAT
GAGACCGTCGAACATCGATGCCACTCTCCTGGAATGGCCAGAAGAAATCACGGAGGTTGGACGCATGATTGCGGAGT
GCACCACGGTGATAGGTGTGCTGAGCTACATTTTGGTGCAACTAGGCGGCGAGGTCGTCAACATTGGTCTTCTATCG
TTCATGAAACAATTGAGTCACGAGCCTGCCAAGCTCATATTCTTGATCAGCAATCTGCTCATACTCGCGTGCATACC
ATGTCGTCTTGCTGGTAATAGGCATGCTGAAGACGCGATACTCGTGGTTGCTGTTCCCGGCTCTTGGTTCCTCCTCA
TGTTCTTTGCTGGCGCTATCCGGTTGACCGGTCCATTCGTTACCATGGTCTACAGTATGATAACCGGTGACATGTTG
ACCTTTGGGATAATCTACATGGTGGTGCTGTTCGGATTTTGCCAGTCGTTCTACTTTTTGTACAAAGGCTTCCCGGG
AGTGAAATCATCCCTCTACAGTTCCTATCATTCGACCTGGATGGCACTGTTTCAGATAACCCTCGGCGATTATAACT
ATACGGACCTTGGTTACACGACCTACCCTAATTTATCGAAGATGGTGTTCGCCATATTTATGGTCCTGGTGCCCATA
CTGCTTTTGAATATGCTGATTGCGATGATGGGCAACACTTACGCGCATGTGATCGAGCAGAGCGAGAAGGAATGGCT
GAAGCAATGGGCGAAAATCGTGGTTTCTCTGGAGCGTGCAGTCGCGCAAAAAGATGCGCAGAATTATTTGCAAGAAT
ACAGTATTAAACTGGGGCCTGGAGATGACCCGAACAACCCCGCCTCGGAACAGCGCGGAGTCCTGGTTATTAAAAGT
AAATCGAAAACCAAGGCGAAGCAACGCAAAGGCGCGGTGGCTAATTGGAAGCGCGTAGGCAAAGTGACGATAAACGA
ATTGAAGAAACGTGGCATAACAGGAGAGGCGTTGCGACGAGTCATGTGGGTCGAGCATCTTTCTCCACTCCTCGAG
ACACTTTGAGAGCTCTCGGATCTGTAGGTATTGTGAGAGCTGTAGGAACTCTCGGACCTGTAGGTACTGTGAGAGCT
GTAGGAGCTCTCGGACCTGTAGGCACTGTGAGAGATTCGAGCATGGCCGAGGATTTTCAGGATCCGCTTTTGGAGCT
TGTGATTGCTTCCGAAAATACGGACGATCCTGAAACGCTGTTGAAAATAGCGGAGCGGGCCGCGGCGAATTTCGAAG
TGGAGAGCAGTTCGAAAATAAATCTGCAAATTTTGGAGCAATTCACGATGACTAAGCTACCTATGGAGGAGAAAGTT
GCCGCTACAAAGAAGCAGTACTTTGTTGAATCGAGTGACAACGATTTTGGTGGCGACAACCTACTCGGAACCGAGGC
CCGTCTACGTAGAATAAGATCAGCGAACAACAGATTTATCACGACACGGAGACGGTCGCGGCACACCGACGACGACC
TGTCATCCACGTCGTCCACATCCGCCGATAGAAATCCTCAATATCAGCCATTGCTTAACGGCCCTGAGAACTTGGTG
AGCCGTCAAATCGAAAGTCGGGAGAGCTCTATCGAAGCAATTAAGCCGCAAGTAAAGCAGAACGGATCATGCGATTC
AGTGAAGATCAAGGTTCAGAAGCGTCGACCGAAAACGGCGAAAAATAGGGTATCACCGAAGGAAATAGAGGAGGCTG
GTCCGAGGAGAAGAGAATCGATCGAGCGGAATAAGGCGGTTTCACCGGCGACGTCGCCTACTGATCCGCTCGAACCA
TGGAGCACACGCGGCATTAAGGACATGAACACGATATTGGCTTGGGAGGAGAATACGCCGGACAGTCCTTAA

FIGURE 75 - SEQ ID NO: 43

<> 43
<> 2898
<> DNA
<> Dendroctonus ponderosae
<> gi|478256802
<> ?
>(gi|478256802:c>97259-97121, c97009-96855, c96447-96225, c96069-95928,
c95914-95701, c95626-95527, c95477-95289, c95232-94892, c94761-94610, c94557-
94341, c94257-94030, c93923-93801, c93748-93636, c93571-93415, c93133-92729)
Dendroctonus ponderosae unplaced genomic scaffold Seq_1102706, whole genome
shotgun sequence
ATGGGTGGGTGCCAATGTAAGCCATGCTGCAGACACAAGAAATCGCACTACACTGGAGGCTCAATTTTGGATCGAGT
AATTAGCCAAAGCTCCAATCAAGACCAGTGTTTGTTATACCGATTGGCCAACTACAAGAAGGGAGGGGAATTAATTG
ATGCCTACAATGCAGGCGGGCAGATTGAGTGCGAGAAGCTGATCCGCGACCAATTCGCGCAACTGATGTATCAGGAT
GGCAAAGGGAAGATTATCAACCGATCTGAGTATCTAAGATGGAAATTCAGGGATCATGAGCATGTGATTCTTCCAAT
CGAAGCGTCACTAAGTCGTTACGACCCATTAGGCAAATGGACCGACCATGAAGCCTGCTGGCAAATGCAGTACAGAG
GCTCTCTAGGCGAATCCCTGCTCCATCTGCTCATTATTTGCGACAGCAAAATCCACACCAGACTGGCAAGAACGTTA
ATTAAATGCTTCCCGAAACTGGCGCTTGATGTTGTCGAGGGAGAAGAGTACTTAGGGGCTAGTGCTCTTCACCTAGC
TATAGCCTACAGCAACAACGAACTAGTGCAGGACCTAGTTGAGGCTGGAGCTAACGTGAACCAACGAGCTATCGTA
AGCAAATCGCTGATAAAACCGGCAAAATTAACGCAAAAAACCGTTTTTTTCTGCCGAGAGATCAGCAAAAACAGCGA
CCAGCTAAGCATACAGACTACGAAGGTTTGGCTTATTTGGGCGAGTATCCACTGGCTTGGGCGGCGTGTTGTGCCAA
CGAAAGCGTCTACAATCTGCTTCTGGACAGCGGCGCTCATCCAGATTTGCAGGACAATTTCGGCAACATGATCCTTC
ATATGGTGGTCGTTTGCGATAAATTGGATATGTTTGGCTACGCGCTTCGACATCCCAAACTGCCGGCTAGTAATGGG
ATTATTAACAAAGCTGGATTGACTCCACTCACTTTGGCCTGCAAACTAGGTCGTGCGGAAGTGTTCAGGGAGATGTT
GGAACTGTCCTGCAAAGAGTTTTGGAGATACAGCAACATTACATGTTCGGCGTATACTCTGAACGCTTTGGACACTT
TGCTGCCTGATGGTCGCACCAATTGGAACTCTGCCCTGTTCATTATCCTCAATGGCACCAAGGAGGCGCATCTCGAT
ATGTTGGATGGAGGCATCATTCAAAGACTGCTGGAGGAAAAATGGAAAGCCTTTGCTCGGAACCAGTTCCTCAAACG
CTTAATTATCCTGATAGTTCATCTAGCTTTTATGTCACTGGCTGTGTATATGAGGCCTGATGATCCGGACGAACCGT
TACTGGAATGGTCCGACGATCCTACAGTTATCATTCGGTATCGTCGGCTTTTCCAAGAGAATCCAGAGGTTTTACTG
GGGTTTTGTAGATTTACTGCTGAAATTGGGACGCTACTAAATGTGCTCAGTTACGTTGTTGTACAGCAGGGAGACGA
AATAAGGAACCAAGGATTTCTCTCTTTTTTGAAACAACAAACAAATTCCCCGCCAAAGTGCATTTTCTTAGTGTCCA
ACTTGATGATTCTGGCATGCATCCCTTGTAGACTGGCCGGAAACCGAGGGTTGGAAGAAACAATTTTGATCTTTGCT
GTGCCCGGATCCTGGTTTTTGCTCATGTTTTTTGCCGGTGCTGTTCGCTTAACCGGACCATTCGTCACAATGATCTA
CAGCATGATCACCGGGGACATGTTAACTTTTGGAATAATCTACACAATTTTCCTTTTCGGTTTTTCCCAGTCGCTTT
TCTTCTTGTACAAGGGAAATCCCAGCGTTAATGGCACGTTGTATCACAGCTACAGCTCCACTTGGATGGCACTGTTT
CAAGTCACAATGGGAAATTACGATTACTCTGAACTGGCGCTAACAACATATCCAGGTGTGGCCAAGTCCGTATTCGG
TCTTTTCATGGTATTCGTCCCAATATTGCTCTTCAACATGTTGATTGCCATGATGGGAAACACTTACGCTCATGTTA
CCGAACAGAGTGAAAAGGAATGGGTAAAACAATGGGCGAAAATCGTAATTTCCTTGGAAAGGGCCATCCCACAAAAG
GAGGCTCATAATTACCTACAGGAATATAGCATATCCTTGGGACCAGCTGAAGATCCAGCAACCGAACAACGAGGAGT
GATGGTGATAAAATCGAAAAACAAAACTAGAGCCAAACAACGAAAGGGAGCAGTCAGCAATTGGAAGAGAGTGGGAA
AAGTTACAATAAAAGCGCTAAAGAAAAAAGGGATGACTGGGGAAGAGATGCGCTGCCTAATGTGGGGCGAGAGTCA
ATTAACACGCCGGTAAAAGTAAAAGGGCCTAAAAGAGACCCTTTGGCAAACCCCCAAGGCCCAGACTTGGCCAATGG
CTTCGGGGATGCTCTAACTTCTGCTCTGGATGTAATGGCGTTTACCCACGATTTGGACATTAATGCTCAAGGCCTAA
ATTTAGCAAAACAAACTCTAAATCCTAAGCCTTTTACGGACCCTCTAAGAACTCTGGTTTTGGAGTCTCTAGTGGAG
ACCAATTCAGCCAGATTGAGCGTTTTGGCTGCACAAGCAGCCAATTTGCCTGATACTGCCGAGATCGTCTCATGCCC
AAATACGGCCACCACTTCCGTGAAGAACCTCGCAGGAATTTTTGCAGGGACTGGCAATTTTGTGAAGAAATTGAGG
AGAAAGTGAAGAAGAAAAAATATGCCGTTTTGGAATGCAGCGATAGCGAGAGCTTCGGAGGCAAGTGCCAGGGCATT
TCAACGCATTTCCAGTCAAAGACTTTGAAATATTGCAGAAGTGCTGCTGGGGACAATATCACGGGTGAAGAGGGCCA
GACTGATACATATGCGACATTCTGCAAACAGGAAAAGGAATTTAGATAA

FIGURE 76 - SEQ ID NO: 44

<> 44
<> 3444
<> DNA
<> Nasonia vitripennis
<> XM_001602538.2
<> ?
>gi|345485101|ref|XM_001602538.2| PREDICTED: Nasonia vitripennis inactive
(Iav), mRNA
ATGGGTGGGGCATGCTCCTGTCAGGGTCGAGACAGCCAGGTCAATGCTGGCTCGATCCTCGATCGCGTGATCAGCCA
GGCGAGCGACGAGGACCAATGTCTGCTCTACCGGCTGGCCAACTACAAGAAGGGCGGCGAGCTGATCGAGGCCTACA
ACCAGGGCGGTCAAGCCGAGGTCGAGCGTCTGATCCGCGAGCAGTTCGGCATCCTCATGTACGCCGACGGCAAGGGT
CAGACGATCAACCGGGCAGAGTACCTCCGCTGGAAGTTCCGGGACCTGGACCAGGTCATCCTGCCGATCGAGGCGTC
CCTCTCGCGCTTCGATCCCTTGGCCCAGTGGTCGGATCACGAGGCCTGCTGGCAGATGCAGTACCGCGGCTCGCTGG
GAGAGACGCTGCTCCACGTGCTCATTATCTGCGACACCCGCACCCACACCCGGATCGCGAGGACGCTGCTCAAGTGC
TTCCCCAGACTGGCCATAGACGTGGTCGAGGGAGAGGAGTACCTCGGCGCGAGCGCGCTGCACCTGGCCATAGCCTA
CGCTAACAACGAGCTGGTCCAGGATCTCGTCGAGGCCGGGGCCATAGTGTCGCAGCGGGCCATAGGAAGCTTCTTCC
TGCCGAGGGACCAGCAGAGGCCCCGACCGGCTAAGAGCACCGACTACGAGGGACTGGCCTATCTCGGCGAGTACCCG
CTCGCCTGGGCGGCCTGCTGCGCCAACGAGAGCGTCTACAACCTGCTCCTCGACTCGGGAGCCCACCCCGACGAGCA
GGACACCTTCGGCAACAGCATCCTCCACATGGTCGTCGTCTGCGACAAGCTGGTCAGATTCGGCTACGCTCTGCGTC
ACCCGAAGCTACCAGCGAGCAACGGCATAGCTAACGCAGCCGGCCTGACCCCGCTGACACTCGCCTGCCAGCTGGGA
CGTGCCGAAGTCTTCCGCGAGATGCTCGAGCTCTCCGCCCGGGAGTTCTGGCGATACAGTAATATCACTTGCTCGGC
GTATCCGCTCAACGCACTCGACACGCTGCTGCCCGACGGAAGGACGAGTNNNAACTCGGCCCTGTTCATCATTCTCA
ACGGTACGAAGGAGGAGCACCTGGACATGCTGGACGGCGGCATCATACAGCGGCTGCTGGAAGAGAAGTGGAAGACC
TTCGCTCGGCTGCAGTTCTTTGAAGCGGCTCGTAATCCTCGTCTTTCACCTGGTGTCGCTGTCGCTGGCCGTTTACTT
TCGGCCCGCGGACACTGACGCCGAGTTGGCCCAGTGGCCCGAGGAGATCACCGACGTCGTCAGAGTCATCGCCGAGT
GCGTCACCGTCCTCGGCGTCTTGGGTTACATTCTACTCCAGCTCGGAGGGGAGATCGTCAACATCGGCTTCTTCTCC
TTTTTCAAACAGCTGAGCCACGAACCTGCCAAGTTCATATTTCTCATCAGCAACCTCCTGATTCTGGCCTGCATCCC
GTGCAGACTGTCCGGCGACCGACACACCGAGGACGCCATTCTCGTGGTCGCCGTTCCGGGCTCCTGGTTTCTCCTGA
TGTTTTTCGCCGGGGCAGTACGTCTGACCGGACCCTTCGTCACGATGGTCTATAGCATGATACTCGGCGACATGCGG
ACTTTTGGCATCATCTACATGATCGTCATCTGCGGCTTCACCCAGGCGTTCTACTTCCTCTACAAGGGCTACCCGGG
AGTGAAGACGACCCTCTTCCATTCCTACCCCTCGACGTGGATGGCGCTATTTCAGATAACTCTCGGCGATTACAGCT
ACTCGGACCTCAGCATGACGACCTACCCCAATCTCAGCAAAGCGGTCTTCACCATCTTCATGGTCCTCGTGCCGATC
CTCCTGCTCAATATGCTGATAGCCATGATGGGAAACACGTACGCGCACGTGATCGAGCAGAGCGAGAAAGAATGGAT
GAAACAGTGGGCGAAAATCGTGGTTTCGCTGGAACGAGCTGTGTCGCAGGACGACGCGCACAATTACCTCCAGGAGT
ACAGCATAAAATTGGGCCCAGGAGACGACCCGAACGATCCAGCCTCGGAGCAACGGGGCGTCATGGTCATAAAGAGC
AAATCGAAGACTCGGGCTCGTCAGCGGAAAGGCGCCGTTGCTAATTGGAAGAGAGTCGGAAAGGTAACGATCGCCGA
GCTGAAAAAGCGTGGCATGACCGGGGAGGAGCTTCGTCGCATCATGTGGGCCGAGCGTCCTTTTCCACGCCGGTCA
GGTCCAGCCCGATCCTGATGGAGCCGGTGTCATCAGTGCCAGGCGGTTTCGGCGACGCCCTGACGTCAGCCCTCGAC
GTTATGACTTTCGCCGCCGATGTGCCGGTGCCCATTGAGGGTAGTATACCCAAGCCAGTCGCCGTCGCCCCGGGCCA
ACAGCCGACTACAACACTTGCACTACCCAATGGAGCTGCGAAACCTCAACAGCCGATGATGACAACGTCGACGACAA
CGACGACGATCACGACGACAGTGCAGAAGACTCTCGTTACCGGCACTGCTACAACACCGGCGGTGGGCGTTACGAAG
ACCGTCGCGGTTCCAGCGGCGACCACCGTCAGCACCACAACGACTCGAGCATCAGCATCAGCAGTGCCCCCCACAGT
TCGGCCGTCAGAGCTCGGTCCAGCCTCGGCCCCTTGCAGCGCCGACCCACTGCTGGAGTTGATGCTCGCGACGGAGG
ATCCAGGCTCGTCGGAGGAGACTCTGCAGCGTCTGGCGCACTCGGCCCGGATCGTGGGCGAGAGCGCCACCACCAGC
GCCAAGTCCGATATCGATTCGAGCTTCCTCGAGAGGCTTGCGCTCGGAGGTCTCGGACTCGCCGCGATGCCCGAACA
GCCTGACAAGCCCGTCGAGCCCAAGAAGAAGCAGTATCTCGTCGAGTCCAGCGATAACGATATCTGTGCAACGACG
GTCAGCTGGAACGGAGGCTCGACTGCGGCGCATCAGGTCGGCCAGTAGCCGGCTAGCCCCGACGACGACGACGTCG
ACGTCGCGACGGAAGTCCGGCCAGCAGAAGCAGCAACGCGAAGCCAGGGACGACGAGAGCACCTCGTCCGCCGCTTC
GCTCGACAACATTTCCGGCTACCAGCCGCTCCTGAACGAGCCGGACACCACCGCGGACCAGCCTGCCACGGGAACAG
AGGACAATAAGCCGGCCAACGGCAGGAACCTACGCAAGAGACCCAAGACCACGAGTAACGAAGGCAAGGTCTTCTGT
AGTAGAAGGACAATTGTTGTACTTAATAAAAATAAGAAGAATAAAAAGCTCGAGACATCTGAAGCCAACATGAACGC
CAGGAAAAAGGAAACTCTTCTTGCACTGCACGACATGACAAGTTTGATCTCAGGCCGTGTACTCACCCTGGAACAGG
CCAATGAAAATGGCTATGAAATGCTGGAGCAGTTGAAGCATAAGTTGGACCCATAA

FIGURE 77 - SEQ ID NO: 45

<> 45
<> 3330
<> DNA
<> Camponotus floridanus
<> gi|307168683
<> ?
>(gi|307168683:95300-96124, 96482-96707, 102648-102763, 105291-105527,
107874-108025, 113417-113633, 114465-114626, 115036-115233, 115678-115787,
116993-117339, 117477-117731, 123276-123588, 124554-124725) Camponotus
floridanus unplaced genomic scaffold scaffold2146, whole genome shotgun
sequence
ATGGGTGGTGTTTGCTCGTGTCGCGTTGGTCGAGGTAACCAGCTTAACGCAGGCTCAATTCTCGATCGCGTCATCAG
CCAGGCAAGCAACGAGGATCAGTGCTTGTTGTATCGGCTGGCCAATTACAAAAAGGGCGGCGAGCTGATCGAGGCGT
ACAATCAAGGTGGCCAGCCAGAAGTGGAGAAATTGGTGCGCGAGCAATTCGGCATTCTGATGTACGCCGATGGTAAG
GGCCAGGTGATCAATCGCGCCGAGTATCTGCGTTGGAAGTTTCGTGACCTCGAGCAGGTCGTGCTGCCGATCGAGGC
ATCGCTGTCGCGCTTCGATCCACTCGCCCAATGGAACGATCACGAGGCCTGCTGGCAGATGCAATACAGAGGCTCGC
TGGGCGAGGCTCTGCTTCATGTCCTCATCATATGCGACACGCGGATACACACCAGAATAGCGCGTATATTACTCAAG
TGCTTCCCGCGACTCGCTATCGACGTCGTCGAGGGCGAAGAGTATCTCGGAGCGAGCGCCCTTCACCTGGCGATCGC
TTATAACAACAACGAACTCGTGCAGGATCTGGTCGATGCGGGCGCGATTATCTCGCAGCGGGCCATCGGTAGCTTTT
TTCTACCGCGTGATCAGCAGGGAATGAATCCCGTTAGAAACACCGATTACGAAGGACTCGCGTATTTAGGCGAGTAC
CCGCTCGCCTGGGCCGCTTGCTGCGCTAATGAAAGCGTCTACAATCTGCTGCTTGATTCCGGTGCGGATCCTGACGA
GCAGGATTCTTTCGGAAATATGATTTTGCATATGGTCGTAGTTGGCGATAAATTGGATATGTTCGGCTATGCTCTGC
GACATCCGAAGCTTCCCGCTCGCAACGGAATCGCGAATGCTGCGGGTCTGACCCCGTTGACACTCGCCTGCCAACTT
GGGCGTGCCGAGGTCTTCCGTGAGATGCTGGAACTGTCCGCGCGGGAGTTCTGGCGTTACAGTAATATCACCTGCTC
GGCGTATCCCCTCAATGCCCTCGACACGCTACTACCAGACGGCAGAACAAACTGGAACTCTGCGCTATTTATCATTC
TGAACGGTACGAAGGAGGAGCACTTGGACATGCTGGACGGTGGTATTATTCAGCGATTACTTGAGGAAAAATGGAAG
ACCTTCGCGCGATTGCAGTTCCTGAAGCGATTGATTATCTTGGTGTTTCACCTGGCCTCGCTGTCCTTAGCGGTATA
CTTCAGACCCGCGGATACGGATGCCGTGCTGCTGCAGTGGCCCGAGGAGATAACGGACGTCATCCGTACCGCGGCGG
AGTGCATCACCGTGCTGGGCGTGCTCAATTACATCCTGGTACAACTGGGTGGCGAGATGATCAACGTCGGACCGCTG
TCGTTTCTGAAGCAACTGAGCCACGAGCCAGCCAAGTTGATATTCGTGATCAGCAATCTACTCATTCTCGCGTGCAT
TCCATGTCGTATCGCCGGAAATCGGCACGCGGAGGATGCGATATTGGTGTTCGCCGTCCCGGGCTCCTGGTTTCTTC
TCATGTTTTTCGCCGGAGCAATTCGATTGACCGGTCCATTCGTCACGATGGTATACAGCATGATAACCGGTGATATG
CTGACTTTCGGTATAATCTATACAATCATGCTCTTCGGATTTTCGCAGTCGTTTTATTTTCTCTACAAGGGATTCCC
AGGCGTGAAATCATCTCTTTATCATTCTTATGTTTCGACCTGGATGGCATTGTTTCAGATAACCCTCGGCGATTATA
ACTATGCGGAATTGAATAACACGATCTATCCCAACTTGAGCAAAACCGTCTTCGCGATTTTTATGGTGCTTGTGCCC
ATTCTGCTACTTAACATGTTGATTGCCATGATGGGTAATACGTACGCACATGTTATCGAGCAAAGCGAGAAAGAATT
CGTTAAGCAGTGGGCAAAAATAGTGGTGTCTCTGGAACGTGCCGTATCGCAAAAAGACGCTCATAATTATCTGCAAG
AATACAGCATCAAGCTAGGACCCGGCGACGATCCAAACAATCCTGCTTCGGAGCAAAGAGGCGTGCTCGTTATTAAA
AGTAAATCGAAAACCAAAGCGAAGCAGCGTAAGGGCGCCGTAGCTAATTGGAAGCGAGTCGGAAAAGTTACGATAAA
CGAACTGAGAAAACGAGGGATGACTGGGGAGGAGCTTCGACATATAATGTGGGGTCGTGAGTCCTTCTCTACTCCTG
TACGAGTCAGTCCCAATGCTGGCCAACCGCAAGTGTCGGCAGTTACTGCAGGTTTTGGTGATGCACTAACCGCAGCT
TTGGACGTAATGGCCTTTGCACATGACTTTGACTTATCCGCGGCGACAGAAGGCATACCCACCAATATCGATGCGAA
ACAAACAAAAACGACACAATCGAAAGCCATTCCCAACGATCAGATGAAAACGACCCAGAATAATCCAGAAACAGTGA
CGAATGTCCAACCACATAAACAGCCTATTGGGGAGCCAACTAAATTGTTAGGTCTTACGGATTTAATCGATAATTCC
ATTGGTCCCGTGAAGGATGTGGAAGCGATGAATTTAAAAAATACGAACCAAACAAAAGCGCTCGAAGCATCTATGGA
GTTCGAAGATCCATTTTTGGAACTAGCCATCGCTTCTGAGACTACGACAAATTACGAAATCTTACTACAAATAGCGA
AGTCTGCTCTAGCTGCCAGTGAAGCTTCGGTGAAAACTGCAATTGATCCACAAATTCTCGCACATTTTGCTATGATT
CCTCCGCCGATCACTGAGAAATTCATCGTTAAGAAGCAATACTTTATGGAATCTAGTGATAACGATGTCGGTGGGGA
TAATTTATTAGGCACTGAAGCTCGTCTTCGAAGGATAAAATCTGCGAATAACAGGTTCATAACTACATCAAAACGGC
CACATCGTGATGATGATGGCGACAGTTCTTCGTCCACTATATCAATTGAACGAAATCAACGATATCGACCATTATTC
AACGATCCGGAAGAAAGATCGATAAATCATGTCGAAACTGAAGGTCAAAAAACTCCCATGGAAACAATTAAATCGGA
AATCCAGCAGAATGGTAGCATTCCACTCAAGCCACCCGATAAAATTCAAAAGCGTCGACCGAAAACAGCCAAGAACA
GAGTATCACCTAAGGAAATAGAGGAGCCGAGGAGAAGGGAATCGATTGAGCAGAATAAGGCGGCCTCACCACCGACG
TCGTCCTCGGATCCGCTCGAGCCATGGAGCACGCGTGGCATTACCGACATGAACACAATATTGGCTTGGAGGGATAA
CGCACCGGATAGTCCTTAA

FIGURE 78 - SEQ ID NO: 46

```
<> 46
<> 2974
<> DNA
<> Danaus plexippus
<> gi|357618515
<> ?
>gi|357618515|gb|AGBW01005481.1| Danaus plexippus, whole genome shotgun
sequence
ATGGGTGTACCGTTAAGTAAGCTGTGTTCAGCAACGAGTGTCCCAGCCGTTGGCTCGGTTCTCGACCGTGTCATATC
CCAGCCCAGCAGCGAAGATCACACTGTCTTATATAAGCTCGCTGATTATAAAGAGGTTTACTATTAGAAACCTATAC
TAAGGGCGGCGTGGTAGCCGCCGAGCGCCTCATCAGAGAGGAGTTCTCGGCATATATGTACGCTGGTGGACGGGGCC
GGGTCATCAACAGAGCTGAATACCTCCGATGGAAGTTTCGAGACCAGGAAGTTGTTCTCCCAATAGAAGCGTCTCTC
TCACCTCACGATCCTCTAGCGAAATGGGAAGATCACACAGCTTGCTGGCAGATGAGTTACCGCGGAGCACTGGGGGA
GTCACTTCTTCATGTTCTCATTATATGCGACATCCACACAAGATTGGCGAGAACTTTGGTCAAATGTTTTCCGAAAT
TGTCCCTGGATGTCGTCGAAGGTGAAGAATGTGCTAGTTCGTTACATTTGGCCATCGCCTATAGTAATAATGAATTA
GTCCAAGACTTGGTCGAAGCTGGCGCGGATGTTAGTCAGAAAGCTGTAGTTTCTTTCTCCCGAGAGACCAACAAAAA
AATCCACCAGCTCGTCAGACAAATTACGAAGGTTTGGCGTATTTAGGGGAGTACCCACTAGCGTGGGCTGCTTGTTG
CGCTAACGAGGCCGTATATAACCTCCTTCTGGACTCTGGAGCTGATCCAGACGCCCAGGATTCATTTGGAAATATGA
TCCTGCATATGGTTGTAGTTTGTGATAAGTTGGATATGTTCGGCTATGCCCTTCGTCATCCAAAGGTACCAGCCAGT
AACGGCAGACTAAATAAGGCTGGGTTCACACCGCTCACCCTTGCCTGCCAATTGGGGCGAGCCTCGGTGTTCAGGGA
AATGTTGGAGCTTTCATCCAGGGAATTTTGGAGATATTCCAACATCACCTGTTCTGCATATCCATTGAATGCTCTAG
ACACTTTGCTACCTGATGGACGTACAAATTGGAATTCCGCATTATTCATCATACTTAATGGCACTAAACAAGAGCAT
CTTAATATGTTGGACGGGGGAATCATACAAAGGCTCTTAGAAGAGAAATGGAAAACATTTGCCAGAACAAAATTTTT
AAAGCGTCTATTAATCCTCATGCTACATCTGATCTTGCTATCCATATCTGTGTATCTACGTCACAGCAGTCTGGAAG
CGGATGTAGACCCCGACTGGGGTTTAGAGGTCAATGATGCAAGGTCCGGGATAAGATTGGCCTGCGAACTAGGAACT
ATCATAAGCACTCTTTGCTATATTATTCTGCAGCAAGGCGATGAGATCAAAAACCAAGGTGTTGTTGCGTACTTCAA
GCAACTAATCCATGAACCAGCCAAATTTATATTCCTAGCTTCAAACATATTGTTACTGGCGTGTATTCCAGCAAGAA
TAAGCCAAAGAACTACTTTGGAAGAAGCAATACTAATATTCGTACTACCCGGTTCTTGGTTCCTTATGATGTTTTTT
GCAGGAGCCGTGAAGTTGACTGGCCCGTTTGTTACAATGATATACAGCATGATCACTGGGGACATGTTCACATTCGG
CATTATCTACTGCATAGTATTGTTCGGATTCTCGCAATCTTTTTACTTCCTGTATAAAGGGTTTCCGAACGTACATT
CAACTCTGTACTCCAGCTATCCCAGCACCTGGATGGCTCTTTTTCAAATCACGTTAGGCGACTACAGTTACACAGAT
CTCGGTCTGACGATGTATCCTAATTTGTCGAAGACAGTGTTCACTGTTTTCATGGTGTTCGTCCCCATTCTGCTACT
CAACATGCTGATAGCCATGATGGGTAACACATACGCACACGTTATAGAGCAATCAGAGAAGGAATGGGTAAAACAGT
GGGCGAAGATTGTTGTGTCTCTGGAGCGTTCAGTATCCCAGGAAGATGCTCATCGTTACCTTCAGGAGTATTCAATA
GGTCTGGGACCCTCAGACGACCCTCGTTATGAGCAACGAGGTGTTATGGTAATTAAGAGCAAGGCCAAAACTCGCGC
CAAGCAAAGAAAGGGCGCGCTGTCTAATTGGAAGCGTGTGGGTAAAGTTACTATAGCAGAGCTGCGGCGCCGCGGCA
TTAGTGGAGAAGAATTGAGAAGACTCATGTGGGGAGAGTCTCAATATCTACTCCAACCAAAGCACCCTTAAAATGT
GTGCCTCCCCCGGAGTTAGTGACTTCAGAAATTCCAGGAAGTGGAGTTGGACCAGCGTTGTCATCAGCTCTTAACGT
GATGGCGTACACACAAGATCTAGACCTCACCAACACCGGATCAGAACTGCATAAACAGATAACGCCCGATTTGCTCG
TCAATGGCAAGACGCCTGTGACAGCACAGAATACAGCAACCACTCCCAAAGTACCACTTGTAAATCTACCAAATAAA
GCGGGATTGGACGTTCAAAGTACGGGAAGTGATCAGAGCGTGCCAACTGCATTAACTAAGAATATGGACGTTTTGGG
CATAAATATGTCAACACAGGATTTGCTAAAGAATCAAACTATAAACAATCCCGCTACAGCCAACGAAATAGTGTTCA
AAGATTATCTCAGGGATATCATAAAGGCGGAGCAACTTGGTCTAGATAATATTGACATAAAGGCCCTCGCAGAGAAA
GCGGCCAACCTCACCGACGTACCAGAGATAGACATTAACATATCTACGGCTGCAAGGTCTGCCCGTCGTGTGGTAGC
CGGCGCTGTTTCTGGTCTGTTCGGTGTGACAGCAGAGACTCCGCGGGACGCAGGCTGGCGCAGAGAGAGACACGAAC
ATACAGACAGTGACCCTGTCCCAGAGTGCGTCATACTGGGTCGTGCGGCGCGCTCGCCGTGCACGATCTGCTTCC
CGGCGCGCGCCCCCTCCCCCACCTCACCTCTACGTTCCTGCGAGGTAA
```

FIGURE 79 - SEQ ID NO: 47

<> 47
<> 3540
<> DNA
<> Bombyx mori
<> XM_004925264.1
<> ?
>gi|512902215|ref|XM_004925264.1| PREDICTED: Bombyx mori uncharacterized
LOC101737437 (LOC101737437), mRNA
ATGGGTAATGCCATTGGAAAATTTCTAACTGCGGGCAACGTTCAAGGTGCTGGCTCGGTTCTCGATAGAGTCATATC
CCAGCCGAGCAGCGAAGACCACACCGTACTTTACAAATTAGCTGATTATAAGAAAGGCGGTCTACTTTTAGAGACCT
ACGCGAAAGGTGGCATGACAGCCGCTGAAAAGTTAATGAGAGACGAATTCGCTGCATACATGTACGGCGGAGGGAGG
GGCCGGGTCATCAATCGTGCTGAATACTTGAGATGGAAGTTCAGAGACCAAGAACAGGTTGTACTTCCAATTGAAGC
ATCGCTCTCACCTTATGACCCGCTCGCCAAATGGGAAGATCACACCGCCTGTTGGCAGATGTGTTATAGAGGAGCTC
TCGGCGAATCATTGCTTCATGTACTCATTATTTGTGATACTAAGATTCATACAAGATTAGCTCGAACTCTAGTAAAA
TGTTTTCCGAAGCTGTCACTAGATGTCGTTGAAGGTGAAGAATATTTAGGGGCAAGCTCTTTACATCTGGCAATAGC
GTACAGCAATAACGAACTAGTACAAGATCTAGTTGAGGCCGGAGCTGATGTCAACCAGAGAGCCATTGGTAGCTTTT
TCCTACCCCGCGACCAACAAAGAGTTCCGCCAGCGCGACAAACAAATTACGAAGGTCTGGCATACTTGGGCGAATAC
CCCCTAGCCTGGACGGCTTGTTGCGCGAACGAAGCAGTCTACAACCTCTTACTAGATTCCGGGGCAGATCCCGATGC
TCAGGATTCGTTCGGGAACATGATACTACACATGGTGGTCGTTTGTGATAAACTGGACATGTTTGGATATGCCCTGC
GTCACCCTAAAGTTCCGGCCAGTAACGGTCGAATGAATAAAGCAGGTTTCACCCCACTAACCTTGGCTTGTCAGTTG
GGTCGGGCCTCTGTCTTCAGAGAGATGCTGGAGCTATCAGCCAGAGAGTTCTGGCGCTACTCCAACATTACGTGCTC
CGCTTACCCTTTGAACGCTTTAGATACCTTGCTGCCTGATGGGCAAACAAATTGGAATTCGGCTTTATTCATTATAC
TGAACGGAACAAAGCAAGAACACTTGAACATGTTAGACGGCGGTATCATACAAAGGTTGCTTGAAGAAAAATGGAAG
ACTTTCGCCAGGACGAAATTCCTCAAACGTCTCCTCATACTGATGCTGCATCTTCTCCTGCTCTCCGTTTCTGTGTA
CCTACGTCACAGCAGCGCAGAAGCTGATGCCCACCCCAACTGGGGCTTGGAGATCAACGACGCTAGAAGCGGACTGA
GACTTGCCAGTGAACTTGGGACTATATTGAGCACATTGTGTTATATTATACTGCAACAAGGCGACGAGCTAAAGAAT
CAAGGATTGGTCGCTTATTTTAAGCAGTTGATTCACGAGCCGGCCAAATTTATATTTTTGGCGTCAAACATCCTTGT
GTTAGCGTGCATACCGGCCAGACTCCTTAAGGAGACCAACGTGGAGGAAGCCATACTGCTTTTCCTGCTGCCGGGAT
CGTGGTTTTTGTTGATGTTTTTGCTGGCGCGGTGAAATTGACCGGTCCATTCGTGACAATGATCTACAGTATGATA
ACAGGGGACATGTTCACGTTCGGTATCATCTACTGTATTGTCCTCTTCGGCTTCTCGCAGTCATTCTACTTCTTGTA
TAGAGGTTTTCCAAACGTACAGTCGACTTTGTACTCGAGCTACCCCAGCACGTGGATGGCACTATTCCAAATCACCT
TAGGAGATTACAGCTACTCGGATCTCAGTCAGACAACATACCCTAATCTCTCGAAGACTCGTGTTCACGGTGTTCATG
ATATTCGTGCCAATTCTACTATTGAACATGTTGATCGCCATGATGGGAACACGTACGCCCACGTCATTGAGCAATC
CGAGAAGGAATGGGTCAAACAGTGGGCGAAATTGTGGTATCACTAGAGCGTTCAGTGGCCCAGGATGACGCACATA
AGTACTTGCAGGAGTATTCTATAGGACTTGGGCCTTCCGACGATCCGAGATACGAGCAACGAGCGGTCATGGTCATC
AAGAGCAAAGCTAAAACTAGAGCGAAACAGAAGAAAGACGCTTTAACTAATTGGAAGCACGTCGGTAAAGTGACAAT
AGCAGAGTTGAGAAGACGCGGTATCAGCGGTGAAGAGTTACGTAGATTGATGTGGGGCCGTATTTCAATTTCGACAC
CAACAAAAGCTCCCTTGCCGCGAAGAGTCCCAGCCCCGCCTCCAGACTGCGTGGTTTCGTCAGACGTGGGTTTAGCT
AGTGACGTAGGGAACGGTGTAGCACCAGCTCTCTCGTCAGCTCTCAACGTCATGGCCTTCACTCACGAATTAGACAT
TGGCACTACTGGTTCTGATCAAAACAAACTACACCGGACTTGTTGGTCAACGGCAAAACTTCCAATGCCCCAATCT
TAACTACCGGTACCCAAATGCCAAAAGTTTCAAGCAAAACTCTCGGTACACCAGTGGCACGTATTGAAGCATCTTCA
CTTAAGACGCCTTTGGATGTTAAATTAAACCCAACAACATTGACACAGTCCACGGTTCAGGGTAATATAGGTAATGT
CAATATTCCTATAAGTGGAGTGAAAATAACAACAAATGTTGGACAAAACTCCGCGGTAGTACCTGAGATTCAACAGT
CGAATGAAAATCAGAAACCTGAGCAAGTACACCAAGATTATCTGCGTGAACTCATAGTTCTTGCTGAGAAACCTGCA
ACCACTAATCTTGAACTCAAACAACTTGCTGAGAAAGCGGCTGATCTGAGAGATGTACCGGAAATTGATATTAACAT
CAATATGGCTGCAAAATCTGCGCGTAAAATGGTAGCGGGTGCTGTGTCGGGTTTATTCGGTGTCGCCGCTGACACTC
CTGCCCCCGATGCTGGCTGGAGGCGGGATCGTCATGACAACAGCGACAGTGATCCGATATCGGAGTCAGTGCTGTTA
AGTCGAGCATCAAGAGCAAGACGCGCGAGGTCAGCATCGCGACGAGCCGCACCACCGCCCCACATCTATATGTACC
GGCTAGGTCTATGTACTTAGTGGCATCTGAGAGCAGTGCTATAGAAAGTGATGCACCTTGGGATGATCAACCCAGTT
CAGAGAACAATTCAGCTGTAGGTGGTCGTAGAGAAGAGATCGCCCACATTAAAGCTGCAAGACCCTTGTGTATTCAA
CATGCTGCGTCAGGGAGAACGGCTCAAGTAGAACACTCATTATTTGTTGTAGGTCCTGGAACCGGAGCCGAAGTTGA
AAGTACTCCTACTGTACAAAAATCCGAAAAAAAGGCTAGACCTAAAACAACGCGATCTAGACGAAACAGAATATCTC
CAACACCGGTACAAGAAGCGGGCAGCCCTTTGGAGCCCTGGGCCACAGCACAACTATCGAAGCTATCACGTCTCATA
CGCTATTCCAGCTCATCAGCAGCTTCTATCACCTCGCAGACGTCCACGGAACAGGAGCAATCGCCAAGATACTGA

FIGURE 80 - SEQ ID NO: 48

```
<> 48
<> 2982
<> DNA
<> Acyrthosiphon pisum
<> XM_001950061.2
<> ?
>gi|328710193|ref|XM_001950061.2| PREDICTED: Acyrthosiphon pisum transient
receptor potential cation channel subfamily V member 6-like (LOC100162897),
mRNA
ATGGGAAATTCTTGTGCGAGTTGCACAGATTTCTCATTCTCGAAAACAGCTTCAGGATCTGTTCTGGATAGAGTGAT
TTCTCAAGCGTCAAATGAAGACGATTGTTTGTTGTATAAGTTAGCGGATTATAAAAAAGGAGGAGAATTGATCAATG
TGTATAATAATGGTGGTCAGGACGAAGCGGAACGATTTATTGTTGAAAAATTACCCGGCCTTATGTATAACAACGGT
AAAGGTCAAGTGATAAATCGAAATGATTATTTGAGATGGAAATTTCAAAATCGTAAACACGTGGCTGTTAATGTCGA
GGAAAGGCCGGGTCCTCACGATCCGTTAACAAGATGGGTGGACCATGTGGCGTGCTGGCAAATGCAGTATAGAGGAT
CATTAGGCGAAAGTTTGTTGCACGTATTAATCATATGCGATACCGTGATACACACTCGGCTGTCCCGACTACTTCTC
AAACACTACCCGATGTTAAGTCAAGATGTTGTGGAAGGCGAAGAATATCTCGGCGCTAGTGCATTACATTTGTCTAT
TGCTTATAACAACAACGATTTAATCCAAGACCTGGTTGATGCTGGTGCTAATATTTGTCAAAGAGCCATAGGGAGCT
TTTTCTTACCACGCGATCAACAGAATAAAGAAATCAATAACAAACACACGGATTACGAGGGTCTAGCGTATCTCGGG
GAGCTGCCATTAGCGTGGGCTGCTTGTTGCGGGAACCAAACGGTATACAACCTGTTGATTGATGCTGGAGCAAACCC
TGACGCCCAGGACTCATTTGGAAATATGATTCTCCATATGGTGGTCGTTTGTGATAAACTGAGTATGTTTGGTTATG
CTTTGAAACACCCTAAAGTGAAAGCAAGTAACGGTATCATGAACGTGGCAGGACTAACACCTTTAACACTATCGTGC
AAACTTGCAAGAACTAGTGTTTTCCGTGAAATGTTGGAACTAAGTGCACGGGAATTTTGGAGATATAGTAATATTAC
GTGTTCGGCATACCCTTTAAGCGCGTTAGACACGTTACTTCCAGACGGAAGAACAAATTGGAATTCAGTATTGTTTA
TAATTTTGGACGGTACCAAAGAAGAACATTTGGACATGCTCGATGGAGGCATTATTCAAAAATTATTAGAAGAAAAG
TGGAAAACTTTTGCTCGGAAACAATTTATGAAACGTTTAGTTATATTATCCATCCATCAATCATGTTGAGTATTTC
TATATACCTAAGACCCGTGGACCAAGACAAACCACTGTTAGGAGAAGCAGAAGACTGGCAAGACGTGGCAAGGTATT
GTTTTGAAGGCGGAACAGTAGTCGGAGTGCTGTCATATTTAATTGTTCAGCAAGGTGGAGAAATACTCAATCAAGGT
CTGGTAGGATTTTTAAAACAAACGTTCAAAGAACCGGCCAAACTGATATTTCTGATTTCAAATTTATTGATATTGGC
TTGTATACCACCCAGGATGATGGGCGACAAACAGACGGAGGAAGCCATATTAGTATTTGCAGTTCCCGGATCATGGT
TTTTGTTAATGTTTTTGCTGGCGCTATACGCCTGACTGGGCCTTTCGTAACTATGGTGTACTTGATGATCACAGGA
GACATGTTGACCTTTTTCGTCATCTACTCAGTAATTTTGTCTGGTTTTACGCAATCGTTTTTTTTCCTCTACAAAGG
ATCGCCAGACGTCAGTACGTCGTTATATAAATCTTACCCTTCTACGTGGATGGCCTTATTTCAAATTACTATGGGCG
ACTACAATTACGCGGATTTGAGTTACACCGTATATCCAGCGCTCAGCAAAACTGTGTTTACGGTTTTCATGGTGTTG
GTGCCAATTTTATTACTTAACATGTTAATAGCTATGATGGGCAACACTTATGCGCACGTCATCGAACAGAGCGAAAA
GGAATGGATGAAACAGTGGGCCAAGATTGTAGTTACCCTTGAAAGAGCTGTACCACAAAAAGCAGCCAGGAATTACC
TCGAAGAATATAGTATTCAGTTGGCTCCCGGCGACGATGTAAATCCAGAACAAAGAGGATTCATGGTTATCAAATGT
AAAAGCCAAACTAGAGCGAAACAGCGAAAAGGCGCCGTCATAAATTGGAAGAAAAGTGGAAAGTTGGTCATTCAAGA
GCTTCGTAGATTAGAAGGTACTGGCCAGAATCAAGAGATATGATTTGGAAACGATCGTCTCTATCAGCGTCTTCTC
CGGTTGCTAAAAGTGTATCAATAACAAAAAATAAAAGCAAGTCCTATTCTGAAGCAAAAGATGACCAAATTCGGCTT
TCTGGTGCACTAGGAGCAGCACTAGACGCGATTGCAGTAGCTCATGACTTAGACATGACTCTGACAAAAGATCAATC
GATTGATGAATTACACGACCCTTTAAGACAATTAGTAATAATGTCAGAAAGTGATAAAAATATTGATAAAAGTCAAG
TCGAAATAGTGGCGAATGCAGCAGCAAAAATTGCAAATCAAGATTCTATAAAACCGATATCGATTAATTTAGAGCAA
CAAAATGACGTAAAAAATGAAAAAACCAAAATTCCAACTTCCAGTAACACAATAACAAATAGAAAACTCTTAAACAA
GCAATCTAAAAATTTAAGCATGTATGGTTTTGAGAGTCAGGACATGTCAGTAGATAAATACAGCAAAGCAATTGCAA
TCACAAGAAGTATATCAACTCAAACTGGAGGTATTGGTATCATCGAAAAAAAACGAACGACAGATAATTCGACCGAAA
ACTGCAAAAATCAATCGCGTGACGCCCACGCAGAATTTCGCAGTCAAAAGAGGCCAATCGGCACAGCCGGACAAACG
GGAAGACCACAGGGATAACAAGGAGCAACAGTGTTATTGCATCAGTGGCAACAACATGTTGCGGCCGTGGAGCACGC
AAGACCTGGCGCCGTTGAACACGATCATGGCGTGGGGTCCCAACGACGATTTCTGA
```

FIGURE 81 - SEQ ID NO: 49

```
<> 49
<> 825, partial
<> DNA
<> Solenopsis invicta
<> GL767538.1
<> ?
>gb|GL767538.1|:2073946-2074770 Solenopsis invicta unplaced genomic scaffold
Si_gnG.scaffold06207, whole genome shotgun sequence
CAATTTATCGCCAACTACGACCATGTGTAAAATCATATTTCCGAAAGAATCCTGCTCGTCAGGATCCGCGCCGGAAT
CAAGCAGCAGATTGTAGACGCTCTCGTTAGCGCAGCAGGCTGCCCAGGCGAGCGGGTACTCTCCCAGATAGGCGAGA
CCCTCGTAATCGGTATTTCTGGCGGGATTCATCCTTTGCTGATCGCGCGGTAGGAAGAAGCTACCGATGGCGCGCTG
CGAGATAATCGCGCCCGCCTCAACCAGATCCTGCACGAGCTCGTTGTTGTTGTAGGCGATCGCCAGGTGAAGGGCGC
TCGCACCGAGATACTCCTCGCCCTCGACGACGTCGATAGACAGCCGCGGAAAGCACTTGAGCAGTATGCGCGCTATC
CTCGTGTGCATCCGCGTGTCGCATATGATCAGTACGTGCAACAAGGTCTCGCCCAGCGAGCCCCTGTACTGCATCTG
CCAGCAGGCCTCGTGGTCATTCCACTGCGCCAGAGGATCGAAGCGCGTCAGCGAGGCCTCGATCGGCAGCACGACTT
GCTCCAGGTCGCGGAACTTCCAACGTAAATACTCGGCGCGATTGATTGTCTGGCCCTTACCGTCCGCATACATCAGG
ATACCGAATTGCTCGCGAATTAGCTTCTCCACCTCCGGTTGACCGCCCTGATTGTACGCCTCGATCAGCTCGCCGCC
CTTCTTGTAGTTGGCCAGCCGATACAATAAACATTGATCCTCGTTGCTCGCCTGGCTGATCACGCGGTCGAGGATTG
AACCGGGATTGACCTGGCTGCCGCGACCAAAGCGGCACGAGCACGCACCACCCAT
```

FIGURE 82 - SEQ ID NO: 50

```
<> 50
<> 426
<> DNA
<> Schistocerca americana, DNA partial
<> In-house
<> ?
> Schistocerca americana, DNA partial
CACCACAATTTTGGCCCAYTGTTTCATCCACTCCTTCTCGCTCTGCTCGATRACGTGCGCGTACGTGTTTCCCATCA
TGGCGATCAGCATRTTGAGCAGCAGGATGGGCACCAGCACCATGAAAATGGCGAACACTGTCTTGGCCAGCGTTGGA
TATGTCGTGTGGCTCAGTTCTGGRTAGTTATAGTCGCCCATGGTGATCTGGAAGAGCGCCATCCAGGTGGTGGGGTA
GGAGTGGTAGAGCGACGTCTTCACGCCGGGGAAGCCCTTGTACAGAAAGTAGAAGGACTGAGAGAAGCCGAACAGCA
CAACCGTGTAGATGATGCCGAACGTCAACATGTCACCGGTGATCATCGAGTACACCATCGTCACGAACGGACCAGTC
AGCCGGRTGGCCCCCGCGAAAAACATCAGCAGGAACCAGGA
```

FIGURE 83 - SEQ ID NO: 51

```
<> 51
<> 2435, partial
<> DNA
<> Myzus persicae
<> In-house
<> ?
```
GAAAGGCCGGGCCCTCACGATCCGTTGACAAGATGGGTGGACCACGTGGCGTGCTGGCAAATGCAATACAGAGGATC
ATTAGGCGAAAGTCTGTTGCACGTATTAATCATATGCGATACTGTGATACACACTCGGCTCTCCCGACTACTTCTCA
AACACTACCCTATGTTAAGTCAAGATGTTGTGGAAGGTGAAGAATATCTCGGCGCCAGTGCATTACATTTGTCTATT
GCTTACAACAACAACGATTTAATCCAAGACTTGGTTGATGCTGGAGCAAATATTTGTCAAAGAGCCATAGGGAGCTT
TTTCTTACCACGCGATCAACAGAATAAAGAAATCAATAACAAACACACGGATTACGAGGGTCTAGCGTATCTCGGAG
AGCTACCGTTAGCGTGGGCTGCTTGTTGCGGAAACCAAACGGTATATAACCTGTTGATTGATGCTGGAGCAAACCCT
GACGCCCAGGACTCGTTTGGAAATATGATTCTCCATATGGTGGTCGTTTGTGACAAACTGAGTATGTTTGGTTATGC
TTTGAAGCACCCTAAAGTGCCGGCAAGTAATGGTATAATGAACGTGGCAGGACTAACACCTTTAACTCTATCGTGTA
AACTTGCAAGAACTAGTGTTTTCCGTGAAATGTTGGAACTAAGTGCAAGGGAATTTTGGAGATATAGTAATATTACA
TGTTCGGCGTATCCTTTAAGTGCTTTAGACACATTACTTCCAGACGGAAGAACAAATTGGAATTCAGTATTGTTTAT
AATTTTGGATGGTACAAAAGAAGAACATTTAGACATGCTCGATGGAGGCATAATTCAAAAATTATTAGAAGAAAGT
GGAAAACTTTTGCTCGGNNNNNNNNNNNNNNNNNNNNNNTTATATTATCCATCCATTTAATCATGTTGAGTATTTCT
ATATACCTAAGACCCGTGGACCAGGACAAACCATTGTTAGGAGAAGCAGAAGACTGGCAAGACGTGGCAAGGTATTG
TTTTGAAGGCGGAACAGTAGTCGGAGTGCTGTCATATTTAATCGTTCAGCAAGGTGGAGAAATACTCAATCAAGGTC
TGGTAGGATTTTTAAAACAAACGTTCAAAGAACNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNNNNNNNNNNNNNNNNGAG
ACATGTTAACCTTTTCGTCATCTACTCAGTAATTTTGTCTGGTTTTACGCAATCGTTTTTTTTCTCTACAAAGGA
TCGCCAGACGTCAGTACGTCGTTATATAAATCTTACCCTTCTACATGGATGGCCTTATTTCAAATTACTATGGGTGA
CTACAATTACGCGGATTTGAGTTACACCGTATACCCCGCTCTCAGCAAAACTGTGTTTACGGTTTTCATGGTGTTGG
TGCCCATTTTATTACTTAACATGTTAATAGCTATGATGGGAAACACTTATGCGCACGTCATCGAACAGAGCGAAAAA
GAATGGATGAAACAGTGGGCTAAGATTGTAGTTACTCTCGAGAGAGCTGTACCACAAAAAGCAGCCAGGAATTACCT
CGAAGAATATAGCATTCAGCTGGCACCCGGTGACGACGTAAATCCAGAACAAAGAGGATTCATGGTAATTAAATGTA
AAAGTCAAACACGAGCGAAACAGCGAAAAGGCGCAGTCATAAATTGGAAGAAAAGTGGAAAGTTGGTCATTCAAGAG
CTTCGTAGATTAGAAGGCACTGGCCAAAATTTAAGAGATATGATTTGGAAACGATCGTCTCTATCAGCGTCTTCTCC
GGTCGCTAAAAGTGTATCAATAACAAAAAATAAAAGCAAGTCTTATTCTGAAGCAAAAGATGACCAAATTCGGCTCT
CTGGTGCACTAGGAGCAGCACTAGACGCGATTGCTGTAGCTCATGATTTAGACATGACCCTGACAAAAGATCAATCG
ATTGATGAATTACATGATCCTTTAAGACAGTTAGTAATAATGTCGGAAAGTGATAAAAATATTGATAAAAGCCAAGT
CGAAATAGTGGCGAATGCAGCAGCAAAAATTGCAAACCAAGATTCTATAAAACCGATATCGGTTAATTTAGAGCAAC
NNNNNNNNNNNNNNNNNNNNNNNNNNNNNNNNNNNNNNNNNNNNACAATTACAAATAGAAAACTGTTAAACAAGCAA
TCTAAAAATTTAAGCATGTATGGTTTTGAGAGTCAGGACATTTCAGTAGATAAATACAGCAAAGAAATTGTAATCAC
AAGAAGTATTTCAACTCAAACTGGAGGTATTGGTATCATCGAAAAAAACGAACGACCGATAATAAGACCAAAAACTG
CAAAAATCAATCGCGTGACGCCCACACAGAATTTCGCGGTGAAAAGAGGCCAATCAGCACAGCCGGACAAACGGGAA
GACCACAGGGATAACAAGGAGCAACAGTGTTATTGCATCAGTGGCAACAACATGTTGAGGCCGTGGAGCACTCAAGA
CCTGGCACCGTTAAACACGATCATGGCTTGGGGTCCCAACGACGATTTCTGA

FIGURE 84 - SEQ ID NO: 52

```
<> 52
<> 2904
<> DNA
<> Bemisia tabaci
<> In-house
<> ?
ATGTACAATGATGGCAAAGGACAGATCATCAAAAGAGCAGAGTATTTACGTTGGAAGTTCAGAGATCAGCAACAGGT
AACTCTACCTATTGAAGCATCTCTGAGTCCTCATGATCCCCTCGCCAAATGGGAGGACCATGAAGCTTGCTGGCAAA
TGCAGTACAGAGGCTCCTTGGGTGAAACCTTATTACACGTCTTGATAATCTGTGACACAAAAACCAACACTCGCCTG
GCCCGCACATTGCTTAAGTGCTTCCCTCGATTGGCTCAAGATATTGTAGAAGGAGAAGAGTATCTTGGTGCCAGTGC
TCTTCACCTTGCTATTGCATACAATAATAACGAATTAGTCCAGGATTTGGTAGAAGCAGGAGCAAATGTCAATCAAA
GAGCAATAGGTAGCTTTTTCCTGCCCAAAGATCAGCAAAGACCGAGACCTGCTAAACACACAGATTACGAAGGTTTG
GCTTACCTCGGAGAATTTCCTCTTTCGTGGGCAGCCTGTTGCGCCAATGAATCAGTTTACAATCTACTTCTAGATTC
AGGAGCCCATCCAGACATGCAGGACACTTTTGGGAATATGATTCTGCACATGGTTGTCGTTTGTGACAAGTTGGACA
TGTTTGGTTATGCTTTGAGACATCCAAAACTGCCAGCCAGTAATGGTATTACCAACACAGCTGGCCTCACGCCTCTC
ACATTAGCCTGCAAGTTGGGCCGTGCAGAAGTTTTTCGTGAAATGTTAGAACTGAGCGCAAGGGAATTTTGGAGGTA
CAGCAACATAACATGCTCAGCGTACCCTTTAAATGCTCTGGATACCCTGTTACCTGACGGACGAACTAACTGGAATT
CTGCTCTGTTCATCATTCTTAATGGTACCAAAGAAGAACATCTAGACATGTTAGATGGTGGAATCATTCAACGATTA
CTGGAGGAGAAGTGGAAAACGTTTGCAAGACGCCAGTTTTTAAAGCGGCTGGCAATTTTGTTTCTCCACCTTCTCAT
GCTAAGTATGGCCGTATACCTGAGACCAGTGGACAGGGAGCAGCCTCTTATAGGAGGAGATGACTGGTCGGATATTG
CGCGATACGGTTTTGAAGTTGGCACTATCATGGGCGTTTTATCGTATCTAGTTGTACAACAAGGTGGGGAGATTAAG
AATCAAGGTCTTGGAAGTTTCTTGAAGCAATTGATGGCAGAACCAGCCAAAGCAATATTCCTTGTTTCAAATCTTCT
AATTCTGGCTTGCATCCCTTTTCGGATGGCAGGGGACTCGCAAACAGAAGAGGCTATTTTAATTTTAGCCGTTCCTG
GGTCATGGTTTCTACTAATGTTTTTTGCTGGGGCTGTGCGGCTGACTGGTCCCTTTGTTACAATGATCTACAGTATG
ATTACTGGTGATATGTTTACGTTCGGAATTATCTACTCAATTCTTTTGTTTGGGTTCTCTCAGTCATTCTATTTCTT
GTACAAAGGCTCGCCAAATGTGAAGCAAACTTTATTTCACTCTTATCCAACAACTTGGATGGCTCTCTTCCAAATTA
CTTTGGGTGACTATAATTATCCAGAGTTGGCTTTCACCGTGTATCCAACTCTGAGCAAGATAGTTTTCACTAGTTTC
ATGGTTCTGGTGCCGATCTTGCTGCTGAACATGTTGATCGCTATGATGGGTAACACCTACGCTCATGTCATAGAACG
CAGTGAAAAGGAATGGATGAAGCAATGGGCGAAAATTGTTGTTGCTCTGGAGCGAGCTGTTCCCGCAGCAGATGCGC
ATAACTATTTGCAAGAGTACAGCATAAAACTAGGGCCTGGCGATGATCCATCAACGGAACAAAGAGGTGTCATGGTA
ATCAAAAGTAAGAGCAAAACACGTGCCAAGCAAAGAAAAGGAGCTGTATCCAACTGGAAGCGAGTTGGTAAAGTCAC
CATCAATGAATTACGGAAGCGAGGAATGACAGGTGAACAGCTGAATCGAATCATGTGGGGACGAGCTTCCATATCGA
CACCAGTTCGACAGCCTGCCATGGCTCTATTACTTGAAGATAGTGAAGAAGAAATGCTGCAAACAATACTGGTCCA
TTTGGTGGAGCGCTGACAGCTGCCTTGGACGTAATGGCCTTCACCCACGACATAGACTTAAATATTGGTCAAACGCC
GGTCACAGTTTCTGGCCTTGGTGGTGTTTCCGTTCGCAGTGGAGCTGAAGGTCTTCCTCCAGAACAACCATTCCATG
ACCCATTCCGGCAGCTGGTGATTGAAGCAGAAAATCCTCATATTGATGAATCCGAATTAGCAGCTCTTGCAAATGCT
GCTGCAATGTCCGTTGTTGCGCCTGATGATATTCCGACTCCTGTGGTTACACCTGAGCCTGTATCTGCATTACCTCG
ATTGCCCTCTCTTCATCTAGAACCAAGTGACAGTGATGGACTTGGAGATGGACCTCTTCTTGGAAGAGGTAGTCGTG
TGCGCAGAGTTCGTTCTGCACATCTGAAGCAGCAAAAAGCATCTTCTACGAATGGGAATGGCTATTCAGACAGACAA
AGACTTTTTTCATCTAAGAATGAAGACTCAAGTTCAAATACTTCATTAGATTTCGACCTGACAAATCCTCCTTCTCA
ATTGAGGCTCACTCCACCTCCTAGACCGGTAACAGCTGAATTGTGGCTGTAAATCCGAAGAAATACATAGGTGGAA
ACAGTCAAGAGAGGTTAAGGCCAAAAACAGCTAAAGTCAACAGGGTTGCGCCAACCCCCGATGTTCCTGTGCGTCGA
GGGATTTCTGCTAATGGTATCCCAGAATCACTGCCGTCTCCACCTGATCCACTAGAGCCATGGAGCACTCGTAATAT
CGTCAATATGAATGCAATTCTTGCATGGCAGCAAAGTGATCAGGATAGTTTGTAA
```

FIGURE 85 - SEQ ID NO: 53

<> 53
<> 2955
<> DNA
<> Euschistus heros
<> In-house
<> ?
ATGGGCATCATCTGGGGCAGTGGTGCTTCTTCAGTGAATGCTGGGACAGTACTTGACCGAGTGATCTCCCAAGCATC
AAATAAGGATGAATGCCTTCTTTACAAATTGGCCAACTACAAGAAGGGAGGAGAGCTGATAGATGCCTATAATGCAG
GAGGCCAAAGTGAGGTTGAGAAACTGATAAGGGAACAGTTCGGCCAATTGATGTATAATGAAGGAAAGGGTGCTCTC
ATCAACAGAGCTGAATATCTGCGATGGAAATTTAGGGACATGCAACAGGTACAGATCCCTATAGAGGCATCTTTATC
CAGCCAAGATCCATTGTCAAAATGGGAGGATCACCAAGCTTGCTGGCAGATGCAGTATCGAGGTTCACTGGGAGAAA
CATTGCTGCATGTACTTATAATTTGTGATACAAAGATACATACGAGACTAGCAAGGACACTATTAAAGTGTTTCCCT
AATCTTGCCATAGACGTTGTGGAAGGAGAAGAATAYTTAGGTGCTAGTGCCCTCCATTTGGCTATTGCATATTTCAA
CAATGAATTAGTTCAAGATCTTGTTGAAGCTGGAGCGAATGTAGAACAAAGGGCAATAGGCAGTTTCTTCCTTCCAA
GGGACCAGCAAGGGCAGAGACCATCAAAGCACACAGATTATGAGGGCTTAGCCTACCTCGGGGAGTAYCCATTGGCC
TGGGCAGCCTGCTGTGCTAATGAGAGTATATACAATTTACTTCTGGACAATGGAGCTAATCCTGATCACAGGGACAC
ATTCGGAAACATGATTCTTCATATGGTTGTGGTCTGTGACAAACTTGATATGTTTGGATATGCTCTCAGGCATCCCA
AGATGCCTGCTTCAAATGGGATAGCTAATGTCGCAGGCTTAACACCTCTTACTCTTGCCTGCAAACTAGGGCGTGCG
AAGGTCTTTCGAGAAATGTTGGAATTGAGTGCCAGAGAATTCTGGAGATACAGCAATATTACATGCTCTGCTTATCC
ATTGAATGCGCTTGATACACTGCTCCCTGATGGCAGAACAAACTGGAATTCAGCTCTCTTCATAATTCTAAATGGAA
CAAAAGAAGAGCACTTAGATATGTTAGACGGAGGTATAATTCAAAGGTTGCTAGAAGAAAATGGAAARCATTTGCA
AGGAGGCAGTTTTTAAAACGGCTAGTAATCCTAATGCTTCATTTACTCTGCCTGAGCGGAGCAGTTTATCTTCGCCC
AACAGACAGAACTAAACCACTCTTAGGAGGAGATGATTGGAAATCAGTAGCGAGGCAAGGTTTTGAAGTAGCAACTG
TTTTAGGTGTTCTTTCGTATGTTATAGTACAGCAAGGAGGAGAAATAAGGAACCAGGGATTTATATCTTTCATCAAA
CAACTGGACYCAGCTAAAGCCATCTTCCTTGTATCAAATATCTTGATATTAATATGTATCCCATTTCGATTGATGGA
TGACAAAAGAACTGAGGAGGCAATATTAGTATTTGCAGTGCCTGGATCATGGTTCTTACTCATGTTTTTTGCAGGTG
CAGTGAGATTAACGGGACCATTTGTAACAATGGTATATAGTATGATAGTTGGAGACATGTTTACTTTTGGTATAATT
TATTCTATTGTGCTCTTTGGATTTTCCCAATCATTCTATTTTCTGTACAAAGGATTTCCAGGAGTTAAAAATACTCT
TTACAGCTCATACCACAGCACATGGATGGCTTTATTTCAGATCACTCTCGGTGATTATAATTATGCTGAATTGTCGC
ATACTTCATACCCGACATTAAGTAAGACAGTGTTTGCTATCTTCATGATTCTAGTCCCTATACTTCTGCTTAACATG
TTAATAGCTATGATGGGAAATACTTATGCCCATGTGATTGAACAAAGCGAGAAAGAATGGATGAAACAGTGGGCCAA
AATTGTGGTTTCACTGGAAARAGCGGTAAACCAGGAAGATTGCAAACAATATTTACAAGAATACAGCATAAAGCTAG
GACCTGGAGATGACCCATCGACAGAACAGCGTGGAGTAATGGTTATAAAAAGTAAAAGTAAAACCAGAGCTAAACAA
AGGAAAGGAGCTGTAGCTAATTGGAAGAGAGTGGGCAAGGTAACAATCAATGAGCTTAGAAAACGAGGGATGAACGG
AGAACAATTAAGAAGAATAATGTGGGATAGAGCTTCAATATCAACACCAGTTAAAGTACCTCAAAACCCTGTAGTAG
ATGTATTAATGGAAAACACGGCAGAACAACAAGCCCAACAAACTCCAGGAAGTTTTGGAGGAGCATTAACTGCAGCA
CTTGATGTAATGGCTTTCACACATGATTTAGATTTATCAGCATCTGGAATCACTTCTTCCGGCTTAAATGCAAAAGA
ACTTATTGTTAGCGATCCCTTCCGTGATCTGGTGTTGAGCTCCGAAATAGATGTGGGAGAGGAAGAATTGGCAACAC
TTGCGGAAGCTGCTGTTCTATCGGTGATGTCAGGCCAATCTGATGAATCAGAAAAACTAAAAATAGCTAAATTTAAT
AAGCAAATCAGTTTTGAACAGAATGCAGTTCTTGAAGTGAGTGACAGCGATGGATTCCTAGATGGCCAGCCATTGGG
TCAAGGATCACGAGCAAGAAAAGTTAAATCAGCTCAAGAGAGGCAAAGAGCAGAGAGGACGTGGGTGGAACAAGCA
TATCGTCAATAGAGGAACCACCACCATACCTCCCTTTACCTCCCCACCACCACTGCATTCCCATCAACGACCAAGG
CCCAAAACTGCGAAACCTAACAGAGTCGTCCCAGAAGCAGTGGTAGCAAAGCGTCCACAGAGCTCAGCTTTAGGGGA
CAGGGTTAAGTCCCCACCAGAACTCCTTGAACCATGGAGCACAAGAGGCATTGCAACCATAAATACAATACTTGCTT
GGCAACCTTCTGATCAAGATAGCATGTAG

FIGURE 86 - SEQ ID NO: 81

<> 81
<> 1123
<> PRT
<> Drosophila melanogaster
<> NP_572353.1
<> ?
>gi|24640231|ref|NP_572353.1| inactive [Drosophila melanogaster]
MKFLLKKCLRKKAPEMKPGAILDAVISQSSATACKCLLYKLADYKRGGDLIDAINSGGLIAVEQLIREQFGVFMYND
GKGQVINRAEFLRWKYRDHTEVTIPIEASLSIHDPLGKWEDHKACWQMQYRGALGESLLHVLIICDSKVHTKLARVL
LRVFPNLALDVMEGEEYLGASALHLSIAYSNNELVADLIEAGADIHQRAIGSFFLPRDQQRANPAKSTDYEGLAYMG
EYPLAWAACCANESVYNLLVDCGSDPDAQDSFGNMILHMVVVCDKLDMFGYALRHPKTPAKNGIVNQTGLTPLTLAC
KLGRAEVFREMLELSAREFWRYSNITCSGYPLNALDTLLPDGRTNWNSALFIILNGTKPEHLDMLDGGIIQRLLEEK
WKTFAQNQFLKRLLILSTHLLCLSVSVYLRPAHDGEAEDEDSEGSDASAAALLDIQSDEGDSGGGDYNAQTVARYCA
EFATLVGVLSYVIFQQGDEIKNQGLSAFLKQLSHAPAKAIFLFSNLLILACIPFRLIGDTDTEEAILIFAVPGSWFL
LMFFAGAIRLTGPFVTMIYSMITGDMFTFGIIYCIVLCGFSQAFYFLYKGHPQVQSTMFNTYTSTWMALFQTTLGDY
NYPDLNQTTYPNLSKTVFVIFMIFVPILLLNMLIAMMGNTYVTVIEQSEKEWMKQWAKIVVTLERAVPQADAKGYLE
AYSIPLGPSDDSGFEVRGVMVIKSKSKTRAKQRKGAVSNWKRVGRVTLTALKKRGMTGEEMRRLMWGRASISSPVKV
TKQKLKDPYNLHTDSDFTNAMDMLTFASNPASSNGVTLRSVTAPPPAPPAPDPFRELIMMSDQRPETHDPHYFAGLQ
QLANKAFDLVEQTMKTQPQAPVAKKVDPLPVASVAKASPAAPATQATATAAAASDLMAMPLPISNLSNLFQDPKDIV
DPKKLEEFMAMLAEVETEESDSGGPILGKLSLAKRTHNALSKAEIRRDQQGFEGHSHGQFQPMSSVWAPPGLDVDTG
FHFDEAVAEEVLTIEQEAEVETEDGNGGQDSEDIPTAEEVHATMKQFHLRKCQPAQDEAARRAKSARVRRRNKVSPE
QSDDPDERSQRGRSAYTRRTQSPPDPLEPWSTRELQDINKILARK

FIGURE 87 - SEQ ID NO: 82

<> 82
<> 1128
<> PRT
<> Musca domestica
<> XP_005181017.1
<> ?
>gi|557762606|ref|XP_005181017.1| PREDICTED: uncharacterized protein
LOC101887788 [Musca domestica]
MRLFMKKCLRKKPQELKPGAILDAVISQSSATASKCLLYKLADYKRGGDLIDAINTGGLVAVEQLIREQFGIFMYND
GKGQVINRAEFLRWKYRDHTEVTIPIEASLSIHDPLGKWKDHSACWQMQYRGALGESLLHVLIICDSKMHTKLARIL
LRVFPRLALDVIEGEEYLGASALHLAIAYSNNELVADLIEAGADINQRAIGSFFLPKDQQRANPAKSTDYEGLAYMG
EYPLSWAACCANESVYNLLIDHDADPDAQDSFGNMILHMVVVCDKLDMFGYALRHPKTPAKNGIVNHSGLTPLTLAC
KLGRAEVFREMLELSAREFWRYSNITCSGYPLNALDTLLPDGRTNWNSALFIILNGTKEEHLDMLDGGIIQRLLEEK
WKTFAQNQFLKRLLILVVHLLCLSTSVYLRPAHDGDDDEEDETAQANAGLQTNDPENEEYDIQTIVRYCAELCTIAG
VLSFLIFQQGDEIKNQGLSAFLKQLSHAPAKVIFLVSNLMILACIPFRLMGDTDTEEAILIFAVPGSWFLLMFFAGA
IRLTGPFVTMIYSMITGDMFTFGIIYSIVLCGFSQAFYFLYKGHPQLQSTMFDTFPSTWMALFQTTLGDYNYPDLNQ
TTYPNLSKTVFVIFMIFVPILLLNMLIAMMGNTYAHVIEQSEKEWMKQWAKIVVTLERAVPQADAKNYLEAYSIPLG
PSDDSGFEVRGVMVIKSKSKTRAKQRKGAVSNWKRVGRVTLNALKKRGMTGEEMRRLMWGRASISSSPIKVAKKKLKD
PYNLNQEPGGQSNLTSAMDMLNFANDPASSSGLAFRTSGTQDPKEKKDVPHIPAPDPLRDLVLLAEEKPEVHDPQFY
SALIQLANKAYDLVKKTLETQHQPQVEEPIPLTEATSLKDVTLTKQPDPVAADAGLLGDMAMGANLTNLFQDPKDIV
DPKKLEQFLKMVADVETEESDGGGPILGKLSLARRTRNALFKVPIPKSTLGDSSDKLINSVWDKVPADNDEDSIPAF
DFQEALAEHVLTVEQEADVETEDANDDSGETMDDIPTAEEVHATMKQFHLRKRQYQQDDAARRAKTARIRRKNKVAP
DYAGSEEQYGRGRSAPMKKKHDEDEMSPPDPLEPWSTRELQNINKILAKK

FIGURE 88 - SEQ ID NO: 83

```
<> 83
<> 1144
<> PRT
<> Ceratitis capitata
<> XP_004529475.1
<> ?
>gi|498980910|ref|XP_004529475.1| PREDICTED: uncharacterized protein
LOC101456642 [Ceratitis capitata]
MKFFLKKCLRKKPEEMKPGAILDAVISQSSPMANKCLLYKLADYMRGGDLIDALNTGGLVAVEQLIREQFGIFMYND
GKGQVINRAEFLRWKYRDHTEVTIPIEASLSRHDPLGKWEDHKACWQMQFRGALGESLLHVLIICDSKIHTKLARVL
IRVFPNLAQDVMEGEEYLGASALHLAIAYSNNELVADLIEAGADINQRAIGSFFLPRDQQRRNPAKSTDYEGLAYLG
EYPLAWAACCANESVYNLLVDCGADPDAQDSFGNMILHMVVVCDKLDMFGYALRHPKTPAKNGIANHSGLTPLTLSC
KLGRAEVFREMLELSAREFWRYSNITCSGYPLNALDTLLPDGRTNWNSALFIILNGTKEEHLDMLDGGIIQRLLEEK
WKTFAQNQFLKRLLILVIHLVFLSISVYMRPARVADDDDEDEIDASSKDTKALELATELDEDEYDVQTIVRYCAEFG
TIVGVLSYVIFQQGDEIKNQGLPAFLKQLTHAPAKAIFLVSNLLILACIPCRLMGDTDAEEAILIFAVPGSWFLLMF
FAGAIRLTGPFVTMIYSMITGDMFTFGIIYCIVLCGFSQAFYFLYKGHPQIQSTMFNTFPSTWMALFQTTLGDYNYP
DLNNTTYPNLSKTVFVIFMIFVPILLLNMLIAMMGNTYAQVIERSEKEWMKQWAKIVVTLERAVPQADAKNYLEAYS
IPLGPIDDSGYEVRGVMVIKSKAKTRAKQRKGAVSNWKRVGRVTLNALKKRGMTGEQMRRLMWGRASISSPIKITKK
KLKDPYNLNPQNDLTSAMDMLTFANDPAASAGLQLRSSLMDSGAEGKAAKVQEENQQPAPDPLRDLIFLADRRPEMH
DPQYFVGLQQLANQALDLVEQTMGIHPPPTPATDALLLSAAAATTTIGAVTMQTATTVAAPSADLITPLGANLTTLF
QDNKDVVDPQKLQEFLKMLAEIETEESDGGGRPILGKLSLSRRTKSALSKAQIKKDTVGGSPDKLIPSVWSHNLPQP
DEEPEFNFEAALAEEHTLTIEQEAEVETETGNEREDSEDCPTVEEVHATMKQFHLRKRQYQQDDAARRAKSARIKRK
NRISPEQSHECDDGSSGGGGGKSTHPRGASAPGRKHTVSERLSPPDPLEPWSTRELQNINKILARK
```

FIGURE 89 - SEQ ID NO: 84

```
<> 84
<> 1120
<> PRT
<> Aedes aegypti
<> XP_001659888.1
<> ?
>gi|157121231|ref|XP_001659888.1| hypothetical protein AaeL_AAEL009258 [Aedes
aegypti]
MVQFDWRRMCRKKRKVPQGGAILDQVISQSANASNQCLLYKMANYKRGGDLIDAFQVGGQKAVEQLIREQFGVFMYN
NGRGQIINRAEYLRWKYMDNHEVVIPIEASLSPHDPLGKWVDHKACWQMQYRGLLGESLLHVLIICDTKIHTKLARI
LLRVFPELSIDVMEGEEYLGASALHLAIAYSNNELVGDLIDAGADVSQRAIGRFFLPRDQQGLKPAKNTDYEGLAYL
GEYPLAWAACCANESVYNLLLECGADPNAQDSFGNMILHMVVVCDKLDMFGYALRHPKLPCKNGIVNESGLTPLTLA
CRLGRDEVFREMLELSAREFWRYSNITCSGYPLNALDTLMPDGTTNWNSALFIILNGTKEEHLNMLDGGIVERLLDE
KWKTFARNQFIKRLLILALHLFCLSCSVYLRPVRVFKEESEEGSDGGDGAGTAAPDGVDDDEDIDLTTWFRYGFEIA
TVMGVLSYVVLQQGDEIKNQGLISFIKSLGNAPAKAIFLISNLMILACIPFRMMGDVEHEEAILLFAVPGSWFLLMF
FAGAIGLTGPFVTMIFSMITGDMFTFGIIYMIVLFGFSQAFYFLYKGHPEAEDSPFGSYFGTWMGLFQTTLGDYDYA
DLNLTTYPNLAKTVFIIFMIFVPILLLNMLIAMMGNTYAYVIEQAEKEGMKQWAKIVVNLERAVKQEDAKKYLEEYS
IGLGPSDDPRYEIRGVMVIKSKSKTRARQRKGAVSNWKSVLRVTLNELKKRNMTGEELRRIMWGRSSITSPAKISKK
KKIYEEEDPFAITNAIDVMSFTQDIVMVSSEPTGPPTIDPSKPATIAVKPQTAPAAQPIPEIPPQPPLVKRQSVVSA
PPAYDDFPPMKDYKDPLRELVIISESPSVDDHYVQSCKTLANDASTLDHDTLGQLNPFLEAKDVVDPVKEREFLKTL
EALEDTDSEAAEKPVLGKISLIRRAKSAVSRTTSRKKKTDQHPLFTIAWDDKNLTRTHPEDFGALNTAYEYSAEDFK
QDVDEEAREEEEDEGVTVEEVHRRMEELHHRGRASLERDSNSTESSKKHPHRKRQGMGRGRNNKVSPDTSNESVSGK
KDKRMKSAPTGGGTSPPDPLEPWSTRDICNINKLLDTDTQDE
```

FIGURE 90 - SEQ ID NO: 85

<> 85
<> 1137
<> PRT
<> Culex quinquefasciatus
<> XP_001864325.1
<> ?
>gi|170057087|ref|XP_001864325.1| OSMotic avoidance abnormal family member
[Culex quinquefasciatus]
MVKFDWRRMCRKKKNVPQGGAILDQVISQSTNVQGQCLLYKMANYKGGGDLIDAFKMGGQKAVEQLIREQFGVFMYN
AGRGQIINRAEYLRWKYMDNHEVVIPIEASLSPHDPLGKWVDHKACWQMQYRGLLGESLLHVLIICDTKIHTKLSRI
LLRVFPELSIDVMEGEEYLGASALHLAIAYSNNELVGDLIDAGANVSQRAIGRFFLPRDQQKMHPAKTTDYEGLAYL
GEYPLAWAACCSNESVYNLLLECGADPNAQDSFGNMILHMVVVCDKLDMFGYALRHPKLPCKNGIVNEAGLTPLTLA
CRIGRDEVFREMLELSAREFWRYSNITCSGYPLNALDTLMPDGSTNWNSALFIILNGTKEEHLNMLDGGIVERLLDE
KWKTFARNQFLKRLLILALHLFCLSCSIYLRPVHVFKDDDDADDTDGVTDSPDTTDDEGIDLTTWFRYGFEVATVMG
VLSYVVVQQGEEIKNQGFISFLKSLAGAPAKAIFLISNLMILCCIPLRILGDREAEEAVLLFAVPGSWFLLMFFAGA
IGLTGPFVTMIFSMITGDMFTFGIIYTIVLFGFSQAFYFLYKGHPNADESPFGTYFGTWMGLFQTTLGDYDYADLNL
TTYPNLAKTVFITFMIFVPILLLNMLIAMMGNTYAYVIEQAEKEGMKQWAKIVVNLERAVKQEDAKKYLEEYSIGLG
PSDDPRFEIRGVMVIKSKSKTRARQRKGAVSNWKSVLRVTLNELKKRSMTGEELRRIMWGRSSITSPAKISKKKKIY
DEDEDPFAITAAIDVMSFTQDIVMVSTEPVGPLMIDPTKPPVTTVKPTAPTVPSAQPAPGVPMTTAQTAAPTAPQLV
KRQSVVSAPPAYDDFLPAKGFKDPLRELLILSESTSIDEHYAQTCRSLATDASTLDHEEHQQQQQQTVGQLNPFLDA
KDVVDPVKEREFLKTLEALEDTDSEAAEKPVLGKISLIRRARSAVSRTTSRKKKTDQHPLFMIAWDDKTTTIPGGGP
QAVSATAGTAAPEDDFGALNTAYECSAEDLKHDVDEEAREDDPDEGVTVEEVHRRMERFHQRPGRSSPERDSNSTES
SKKQAKGDKRMKSAPSGHGPRHRQMMDTGGGSPPDPLEPWSTKEIVPINKLLDTDTQDE

FIGURE 91 - SEQ ID NO: 86

<> 86
<> 1216
<> PRT
<> Anopheles gambiae
<> XP_310685.5
<> ?
>gi|347963769|ref|XP_310685.5| AGAP000413-PA [Anopheles gambiae str. PEST]
MVHLDPLRLCRKKRKLPQGGAILDQVISQSASASNQCLLYKMANYKRGGDLIDAFQIGGQKAVEQLIREQFGVFMYN
KGRGQIINRAEYLRWKYMDNHEVIIPIEASLSPHDPLSKWDDHKACWQMQYRGLLGESLLHVLIICDTKVHTKLARI
LLRVFPEQSIDVMEGEEYLGASALHLAIAYSNNELVGDLIDAGADVSQRATGRFFLPRDQQGLRPAKTTDYEGLAYL
GEYPLAWAACCANESVYNLLLECGADPNAQDSFGNMILHMVVVCDKLDMFGYALRHPKLPCKNGIVNAAGLTPLTLA
CRLGRDEVFREMLELSAREFWRYSNITCSGYPLNALDTLMPDGSTNWNSALFIILNGTKEEHLNMLDGGIVERLLDE
KWKTFARNQFIKRLLILAIHLFCLSCSVYLRPVRVFADDEGEEGGDATDDDGADDGGPMAVDAVDDDIDLTTWVRYG
FEVATVMGVLSYVVLQQGDEIKNQGFFSFLKSLSQAPAKAIFLISNILILACIPLRMMGDTETEEAILLFAVPGSWF
LLMFFAGAIGLTGPFVTMIFSMITGDMFTFGIIYMIVLFGFSQAFYFLYKGHPNAEDSPFGSYFGTWMALFQTTLGD
YDYADLNLTTYPNLAKTVFVIFMIFVPILLLNMLIAMMGNTYAYVIEQAEKEGMKQWAKIVVNLERAVTQDDAKRYL
EEYSIGLGPSDDPRYETRGVMVIKSKSKTRARQRKGAVSNWKSVLRVTLNELKKRSMTGEELRRIMWGRSSITSPAK
IAKKKRPGEVDDLLGDPFAITAAIDVMSFTQDIVMVSTDTVCPITIPPAAAPGTAAPKAGGTKPVVVAPPPPAAATA
VQQPPPPATTRRHSTASAPATMGLGVEAALPGYKDPLRELVIISESASVDENYAQNVKTLAIDASTLDHVHEIDISQ
QQQQQQQQQQQPQQPQQQQNLGQLTLFQNPKDVVDPVREREFLKTLEALEDTDSEAGEKPVLGKISLIRRAKSAVS
RSTSRKRKTDQHPLFMIAWEDKGDQQRHSTALYDGATGAAPSVGAPGELGQPEQPEDAVTVEELHRRMEQFHQRASV
RERDANSSESGSGKQHAGPKARKPSHHRDGGGSHHHGLGRGKHNKISPDNSNESTGGGGGGASGHGRKQDKRMKS
APILGSGGAGSAGSSAGGRTVAPGGARPDDGTGSPPDPLEPWSTKNIMNINKLLDQDTTEE

FIGURE 92 - SEQ ID NO: 87

```
<> 87
<> 1086
<> PRT
<> Tribolium castaneum
<> EFA10736.1
<> ?
>gi|270014288|gb|EFA10736.1| hypothetical protein TcasGA2_TC012368 [Tribolium
castaneum]
MGAKVCKPCKKRKANTFQGGSILDRVISQASNQDQCLLYKLANYKKGGELIDAYNQGGQAEVEKLIREQFGQLMYQE
GKGQIINRSEYLRWKFRDHEQVILPIEASLSRYDPLAKWNDHEACWQMQFRGSLGESLLHVLIICDTKIHTRLARTL
IKCFPKLALDVVEGEEYLGASALHLAIAYNNNELVQDLVEAGANVNQRAIGSFFLPRDQQRQKPAKHTDYEGLAYLG
EYPLAWAACCANESVYNLLLDSGAHPDYQDNFGNMILHMVVVCDKLDMFGYALRHPKLPASNGIVNKAGLTPLTLAC
KLGRAEVFREMLELSAKEFWRYSNITCSAYFLNALDTLLPDGRTNWNSALFIILNGTKEEHLAMLDGGIIQRLLEEK
WKTFARNQFLKRLLILVVHLLFLSLAVYLRPDDPDESLLTWSDDVTLIARYVCEVGTILGVLSYLVLQQGDEIRNQG
LTAFLKQQLNSPPKLIFLISNFLILACIPCRLYGDKETEEAILCFAVPGSWFLLMFFAGAVRLTGPFVTMIYSMITG
DMLTFGIIYTVFLFGFSQSFYFLYKGFPGVKTSLYNTYMSTWMALFQITLGNYEYSELSATTYPAVSKTVFAIFMVF
VPILLLNMLIAMMGNTYAHVIEQSEKEWVKQWAKIVIALERAIPQSDAQHYLQEYSISLGPSEQDPSTEKRGVLVIK
SKSKTRAKQRKGAVANWKRVGKVTINALKKRGLTGEEMRCLMWGRESINTPVKTKKPVKDPLLDPQGPNLTGGFGDA
LTTALDVMTFTHDLDIVGASQGLNLATNPKPVPPTTTASAVTVNNQINSALNAQQKAVAGAGVGALAMIGTVTQLTD
SQGYIMQNSVKKEEKIVATLEDPFRELVINANDSNCDPEKLKMLALSAANLKDVEELSVAKPQTKSVKSLAGIFAGT
ETFVRKVEETIKKKYAALDPSDSEGFGEPPLLGKISRTRRAKSANLRNSSARSKASDKKKLVAGSQSSSTDTVNNEI
NEKNIENSDLDYAEERIKLVKESLKQVVDVAQIRPINIDVALEEQVSVTISETMRVQGSGDGAEVQSSNVKPKRKKR
SKTAKNNK
```

FIGURE 93 - SEQ ID NO: 88

```
<> 88
<> 1101
<> PRT
<> Megachile rotundata
<> XP_003704666.1
<> ?
>gi|383858353|ref|XP_003704666.1| PREDICTED: uncharacterized protein
LOC100877549 [Megachile rotundata]
MGGVCSCRGLGSQVNAGSILDRVISQASDEDQCLLYRLANYKKSGELIDAYNQGGQAEVEKLIREQFGVLMYADGKG
QMINRAEYLRWKFRDLEQVVLPIEASLSRFDPLAQWNDHQACWQMQYRGSLGETLLHVLIICDTRLHTRLARILLKC
FPRLAIDVVEGEEYLGASALHLAIAYNNNELVQDLVEVGAIISQRAIGSFFLPRDQQRMNPAKNTDYEGLAYLGEYP
LAWAACCANESVYNLLLDSGADPDEQDSFGNMILHMVVVCDKLDMFGYALRHPKLPARNGIVNAAGLTPLTLACQLG
RAEVFREMLELSAREFWRYSNITCSAYPLNALDTLLPDGRTNWNSALFIILNGTKEEHLNMLDGGIIQRLLEEKWKT
FARLQFLKRLIILVFHLTSLSLAVYLRPSNLDTVLLKWPEEVTEVGRTIAECITVLGVLSYILVQLGGEIINIGVLS
FLKQLSHEPAKLIFLISNLLILACIPCRLAGNRHAEDAILVVAVPGSWFLLMFFAGAIRLTGPFVTMVYSMITGDML
TFGIIYMVVLFGFCQSFYFLYKGFPGVKSSLYSSYHSTWMALFQVTLGDYNYTDLSYTTYPNLSKMVFTIFMVLVPI
LLLNMLIAMMGNTYAHVIEQSEKEWVKQWAKIVVSLERAVSQKDAQNYLQEYSIKLGPGDDPNNPASEQRGVLVIKS
KSKTKAKQRKGAVANWKRVGKVTINELRKRGMTGEELRRIMWGRASFSTPVRVSPNVDEPQVSAVTAGFGDALTAAL
DVMAFAHDLDLSTATESIPTNIDVKQSKPKVVSSEQTKLTTNNQEKPSITEKAATEIANKQVNAKDETNKKPNEVVD
VEKMNVKNANNSSTVEEYHDLFLEFVIASESMNDPETLLKMAERVAAEFDSSANPKINLQILEQFTMTKIPMEEQAA
AVKKQYFIESSDNDFGGDNLLGTVARLRRIRSANSRFITARRHSRHVNDDMSSTSSASGDGNPRYQQLLNDTEEVPS
NQRTENRDESIVANKSEVKQNDANCGSRCKAQKRRPKTARNRVSPKETEDSGQRRRESMERNKAVSPATSPTDPLEP
WSTRGIKDMNTILAWEENVPDSP
```

FIGURE 94 - SEQ ID NO: 89

```
<> 89
<> 1101
<> PRT
<> Apis mellifera
<> XP_001121881.1
<> ?
>gi|110748981|ref|XP_001121881.1| PREDICTED: hypothetical protein LOC726119
[Apis mellifera]
MGGVCSFRGRGSQVNAGSILDRVISQASDEDQCLLYRLANYKKGGELIESYNQGGQFEVEKLIREQFGVLMYADGKG
QVINRAEYLRWKFRDLEQVVLPIEASLSQFDPLAQWNDHEACWQMQYRGSLGETLLHVLIICDTRIHTRVARILLKC
FPRLAIDVVEGEEYLGASALHLAIAYNNNELVQDLVEAGAIISQRAIGSFFLPRDQQRTNPAKNTDYEGLAYLGEYP
LAWAACCANESVYNLLLDSGADPDEQDSFGNMILHMVVVCDKLDMFGYALRHPKLPARNGIVNAAGLTPLTLACQLG
RAEVFREMLELSAREFWRYSNITCSAYPLNALDTLLPDGRTNWNSALFIILNGTKEEHLDMLDGGIIQRLLEEKWKT
FARLQFLKRLIILAFHLTSLSLAVYLRPSNTDAQLLKWPEEITEVARTIAECITVLGVLSYILVQLGGEIINIGLLS
FMKQLSHEPAKLIFLISNLLILACIPCRLAGNRHAEDAILIVAVPGSWFLLMFFAGAVRLTGPFVTMVYSMITGDML
TFGIIYMVVLFGFCQSFYFLYKGFPGVKSSLYSSYHSTWMALFQITLGDYNYTDLSYTTYPNLSKMVFAIFMVLVPI
LLLNMLIAMMGNTYAHVIEQSEKEWVKQWAKIVVSLERAVSQKDAQNYLQEYSIKLGPGDDPNNPAAEQRGVLIIKS
KSKTKAKQRKGAVANWKRVGKVTINELKKRGLTGEELRRIMWGRASFSTPVRVSPKGVEPQVSVVTAGFGDALTTAL
DVMTFAHDLDLSTATEGIPTNIDAKQSKPKSATKETKSTVNNQQNVTTNIEPLKSTTENVDDQANNPREKKVTSQAA
TVHEMNLKNANHSSVTEDFQDPLLELVIASENTNDPETLLEIAKRAAAGFETETSSKINLQILEQFTMTKIPMDEKV
NVTRKQYFVESSDNDFGGDNLLGTEARLRRIRSANNRFITTRRRSRNVDDDLSSTSSTSMDRNPRYQSLLNGHENSI
DRPIESRECSIEAINSQIKQNGPCETMKAKVQKKRPKTARNRVSPKEIEKAGPRRRESIERNKAVSPATSPTDPLEP
WSTRGIKDMNTILAWEETAPDSP
```

FIGURE 95 - SEQ ID NO: 90

```
<> 90
<> 1105
<> PRT
<> Apis florea
<> XP_003690727.1
<> ?
>gi|380013353|ref|XP_003690727.1| PREDICTED: uncharacterized protein
LOC100868270 [Apis florea]
MGGVCSFRGRGSQVNSGSILDRVISQASDEDQCLLYRLANYKKGGELIESYNQGGQFEVEKLIREQFGVLMYANGKG
QVINRAEYLRWKFRDLEQVVLPIEASLSQFDPLAQWNDHEACWQMQYRGSLGETLLHVLIICDTRIHTRVARILLKC
FPRLAIDVVEGEEYLGASALHLAIAYNNNELVQDLVEAGAIISQRAIGSFFLPRDQQRMNPAKNTDYEGLAYLGEYP
LAWAACCANESVYNLLLDSGADPDEQDSFGNMILHMVVVCDKLDMFGYALRHPKLPARNGIVNAAGLTPLTLACQLG
RAEVFREMLELSAREFWRYSNITCSAYPLNALDTLLPDGRTNWNSALFIILNGTKEEHLDMLDGGIIQRLLEEKWKT
FARLQFLKRLIILAFHLTSLSLAVYLRPSNTDAQLLKWPEEITEVARTIAECITVLGVLSYILVQLGGEIINIGLLS
FMKQLSHEPAKLIFLISNLLILACIPCRLAGNRHAEDAILIVAVPGSWFLLMFFAGAVRLTGPFVTMVYSMITGDML
TFGIIYMVVLFGFCQSFYFLYKGFPGVKSSLYSSYHSTWMALFQITLGDYNYTDLSYTTYPNLSKMVFAIFMVLVPI
LLLNMLIAMMGNTYAHVIEQSEKEWVKQWAKIVVSLERAVSQKDAQNYLQEYSIKLGPGDDPNNPASEQRGVLIIKS
KSKTKAKQRKGAVANWKRVGKVTINELKKRGLTGEELRRIMWGRASFSTPVRVSPKGVEPQVSVVTAGFGDALTTAL
DVMAFAHDLDLSTATEGIPTNIDAKQSKPKSAIKEQMKLTTNNQENVSTNVEPQLKSTTENANDQANNPREIKKVTN
QVTGIHEMNLKNANHSSVTEDFQDPLLELVIASENTNDPETLLEIAKRAAAGFETEASSKINLQILEQFTMTKIPME
EKVSVTRKQYFVESSDNDFGGDNLLGTEARLRRIRSANNRFITTRRRSRNVDDDLSSTSSTSMDRNPRYQSLFNGHE
NSIDRPIESRECSMEAINSQIKQNGPPCETVKAKVQKKRPKTAKNRVSPKEIEKAGPRRRESIERNKAVSPATSPTD
PLEPWSTRGIKDMNTILAWEETAPDSP
```

FIGURE 96 - SEQ ID NO: 91

<> 91
<> 1055
<> PRT
<> Pediculus humanus corporis
<> XP_002432382.1
<> ?
>gi|242023927|ref|XP_002432382.1| conserved hypothetical protein [Pediculus humanus corporis]
MGAGLCGTSQDPQNQGSVLDRVISQASNKDDCLLYKLANYKNSGELIEAYNIGGQAEVEKLIKEQFGVLMYADGKGE
VIKRAEYLRWKFRDQAQVVLPIEASLSIYDPLAKWEDHEACWQMQYRGSLGETLLHVLIICDSKIHTKLARTLLKCF
PKLALDIVEGEEYLGASALHLAIAYNNNELVEDLVDAGANINQRAVGSFFLPKDQQRAKPLKTTDYEGLAYLGEYPL
SWAACCSNESVYNLLLDVGADPDSQDSFGNMILHMVVVCDKLDMFGYALRHPKVPASNGIINNEGLTPLTLACKLGR
ADVFKEMLELSAKEFWRYSNITCSAYPLNALDTLLPDGRTNWNSAIFIILNGTKEEHLDMLDGGIIQRLLEEKWKTF
ARNQFLKRLVIFFLHIFCLSGSVYLRPDDRNKPLLGGTSVQDVVRYCFEIGTILGVLCYLCFQQGDEIRNQGLISFL
KQLPHDPAKFIFLISNLLILACIPYRVAGDTDTEEAILVFAVPSSWFLLMFFAGAIRLTGPFVTMIYSMITGDMLTF
GIIYSVFLFGFSQSFFFLYKGSKNVSSSLFTSYPSTWMALFQVTMGDYNYNDLSLTAYPAISKMVFTIFMVLVPILL
LNMLIAMMGNTYAHVIEQSEKEWMKQWAKIVVALERAVNQEDCHRYLQEYSIKLGPGDDPSTEQRGVLVIKSKSKTR
AKQRKGALCNWKRVGKVTIRELHKRGMTGEQLRRLMWGRSSISTPVKPAPIKLGHVTSISGVADITVPETTGNTVGT
GGGGLLAALDVMAFTNDLEFSSENQTSTSFKTQPQPSEVSCVESDSNSDPLYNDPLRQLNEELNKTREEILTLARVA
ANNDGIEEIPPQICQYGWINNYNFFGNTFAQNQKVEDPVQQPTFQSTPNHSDSDGLGDGLLLGSNRRLKRTRSANIK
RKFSGSSTNEKNLLEPEDSSSTNSEDFSCLTENYINKNIKVNANFSENSLRSNRSSANLVVKKFGRRSGLKSSTNRI
APADLSPVGNVSKYSETLCNSYCITSSSDVLYQWSIKGITNMNTLLGLENEDSM

FIGURE 97 - SEQ ID NO: 92

<> 92
<> 1109
<> PRT
<> Acromyrmex echinatior
<> EGI60788.1
<> ?
>gi|332020367|gb|EGI60788.1| Transient receptor potential cation channel subfamily V member 6 [Acromyrmex echinatior]
MGGVCSCRVGRNSQVNAGSILDRVISQASNEDQCLLYRLANYKKGGELIEAYNQGGQPEVEKLIREQFGILMYMDGK
GQIINRAEYLRWKFRDLEQVVLPIEASLSRFDPLAQWNDHEACWQMQYRGSLGETLLHVLIICDTRMHTRIARILLK
CFPRLAIDVVEGEEYLGASALHLAIAYANNELVQDLVEAGAIISQRAIGSFFLPRDQQRMNPARNTDYEGLAYLGEY
PLAWAACCANESVYNLLLDSGADPDEQDTFGNMILHMVVVCDKLDMFGYALRHPKLPARNGIVNAAGLTPLTLACQL
GRAEVFREMLELSAREFWRYSNITCSAYPLNALDTLLPDGRTNWNSALFIILNGTKEEHLDMLDGGIIQRLLEEKWK
TFARLQFLKRLIILVFHLASLSLAMYFRPADMEAVLLQWPEEITDVVRTAAECITVLGVLNYILVQLGCEMINVGPL
SFLKQLSHEPAKLIFVISNLLILACIPCRIAGDRHAEDAILMFAVPGSWFLLMFFAGAIRLTGPFVTMVYSMITGDM
LTFGIIYTVMLFGFSQSFYFLYKGFPGVKSSLYHSYPSTWMALFQITLGDYNYADLSNTTYPNLSKTVFAIFMVLVP
ILLLNMLIAMMGNTYAHVIEQSEKEFVKQWAKIVVSLERAVSQKDAHNYLQEYSIKLGPGDDPNNPASEQRGVLVIK
SKSKTRAKQRKGAVSNWKRVGKVTILELRKRGMTGEELRRIMWGRASFSTPVRVSPNAGQPQVSAVTAGFDDALTAA
LDVMAFAHDFDLSTATEGIPTNIDAKQIKTAQSKAALNDQQTKTTQNNPEVVINVQPHNQPIKEETKLSGLTDLIDK
SIDPVKDVEAMNLRNMNQTKALEETVEDPFLELAIASETTTDYKTLLQIAKSALATSEASMKTTIDPQILAHFAMVA
PPTIEKSSIVKKQYFMESSDNDLGGDNLLGTEARLRRIKSANNRFTTSKRSRRDDDGDSSSSTTSVEQSLRYRPLLN
DPEQRPMNRIETEGRKTTVETIKPEVKQNGSIPTKPLDKIQKRRPKTAKNRVSPKETEEPARRRESIERNKAASPPT
SSSDPLEPWSTRGITDMNTILAWRENAPDSP

FIGURE 98 - SEQ ID NO: 93

<> 93
<> 1112
<> PRT
<> Harpegnathos saltator
<> EFN84766.1
<> ?
>gi|307206920|gb|EFN84766.1| Transient receptor potential cation channel
subfamily V member 6 [Harpegnathos saltator]
MGGVCSCRGRGSQVNAGSILDRVISQASNEDQCLLYRLANYKKGGELIEAYNQGGQPEVERLIREQFGILMYADGKG
QVINRAEYLRWKFRDLEQVVLPIEASLSRFDPLAQWYDHEACWQMQYRGSLGESLLHVLIICDTRMHTRIARTLLKC
FPRLAIDVVEGEEYLGASALHLAIAYNNNELVQDLVEAGAIISQRAIGSFFLPRDQQRMNPVRNTDYEGLAYLGEYP
LAWAACCANESVYNLLLDSGADPDEQDSFGNMILHMVVVCDKLDMFGYALRHPKLPTRNGIVNAAGLTPLTLACQLG
RAEVFREMLELSAREFWRYSNITCSAYPLNALDTLLPDGRTNWNSALFIILNGTKEEHLDMLDGGVIQRLLEEKWKT
FARLQFLKRLIILVFHLASLSLAVYFRPADMDAELLQWPDEITDAARIAAECSTVLGVLSYILVQLGGEMINIGPLS
FLKQLSHEPAKLIFVISNLLILACIPCRIAGNRHAEDAILVFAVPGSWFLLMFFAGAIRLTGPFVTMVYSMITGDML
TFGIIYTVMLFGFSQSFYFLYKGFPGVKSSLYHSYPSTWMALFQITLGDYNYADLSNTTYPNLSKTVFAIFMVLVPI
LLLNMLIAMMGNTYAHVIEQSEKEFVKQWAKIVVSLERAVSQKDAHNYLQEYSIKLGPGDDPNNPASEQRGVLIIKS
KSKTRAKQRKGAVANWKRVGKVTINELRKRGMTGEELRRIMWDRASISTPVRVSPNVNEPQVSAVTAGFGDALTAAL
DVMAFAHDFDLSTATEGVPSNIDTRQTKAIPDEQTRTARNNPKAVTDVQPHKQAIGGEETKLSGLTDLIDMSAAEPA
RVEAMNLKNASQAKAHEGAVEDPFLELAIASETTEDYDTLLQMAKSALATSEASTTVDPQILAHFTMIAPPPVEKPI
VVKKQYLVESSDNDLGGDNLLGTEARIRRIKSANDRFISTSKRSHHDDDNDSSSSVTSVDRSQPQYRPLLNDSEESL
ANRVENEGRRTSDVETIKSEVKQNGRGGGGGGVSKPSDKRVQKRRPKTAKNRVSPKEIEEPARRREESIERNKAALS
PPASPSDPLEPWSTRGITDMNTILAWRENAPDSP

FIGURE 99 - SEQ ID NO: 94

<> 94
<> 1104
<> PRT
<> Bombus impatiens
<> XP_003485699.1
<> ?
>gi|350399983|ref|XP_003485699.1| PREDICTED: hypothetical protein
LOC100747394 isoform 1 [Bombus impatiens]
MGGVCSCRGRGSQVNAGSILDRVISHASDEDQCLLYRLANYKKGGELIESYNQGGQAEVEKLIREQFGVLMYADGKG
QAINRAEYLRWKFRDLEQVVLPIEASLSQFDPLAQWNDHEACWQMQYRGSLGETLLHVLIICDTRIHTRLARILLKC
FPRLAIDVVEGEEYLGASALHLAIAYNNNELVQDLVEAGAIISQRAIGSFFLPRDQQRTNPAKNTDYEGLAYLGEYP
LAWAACCANESVYNLLLDSGADPDEQDSFGNMILHMVVVCDKLDMFGYALRHPKLPARNGIVNAAGLTPLTLACQLG
RAEVFREMLELSAREFWRYSNITCSAYPLNALDTLLPDGRTNWNSALFIILNGTKEEHLDMLDGGIIQRLLEEKWKT
FARLQFLKRLIILVFHLTSLSLAVYMRPSNIDATLLEWPEEITEVGRMIAECTTVIGVLSYILVQLGGEVVNIGLLS
FMKQLSHEPAKLIFLISNLLILACIPCRLAGNRHAEDAILVVAVPGSWFLLMFFAGAIRLTGPFVTMVYSMITGDML
TFGIIYMVVLFGFCQSFYFLYKGFPGVKSSLYSSYHSTWMALFQITLGDYNYTDLGYTTYPNLSKMVFAIFMVLVPI
LLLNMLIAMMGNTYAHVIEQSEKEWVKQWAKIVVSLERAVAQKDAQNYLQEYSIKLGPGDDPNNPASEQRGVLIIKS
KSKTKAKQRKGAVANWKRVGKVTINELKKRGITGEALRRVMWGRASFSTPVRTSPNTAEPQVSAVTAGFGDALTAAL
DVMAFAHDLDLSTATEGIPTNIGAKQSKSKTACKDQAKSATNNQEKGSTDVQQQRKLTTENLDNLASSHNDIDKTSS
EFVAVREMNSKNASHSSMAEDFQDPLLELVIASENTDDPETLLKIAERAAANFEVESSSKINLQILEQFTMTKLPME
EKVAATKKQYFVESSDNDFGGDNLLGTEARLRRIRSANNRFITTRRRSRHTDDDLSSTSSTSADRNPQYQPLLNGPE
NLASRQIESRESSIEAIKPQVKQNGSCDSVKIKVQKRRPKTAKNRVSPKEIEEAGPRRRESIERNKAVSPATSPTDP
LEPWSTRGIKDMNTILAWEENTPDSP

FIGURE 100 - SEQ ID NO: 95

<> 95
<> 1024
<> PRT
<> Bombus terrestris
<> XP_003396191.1
<> ?
>gi|340715377|ref|XP_003396191.1| PREDICTED: transient receptor potential
cation channel subfamily V member 6-like [Bombus terrestris]
MGGVCSCRGRGSQVNAGSILDRVISHASDEDQCLLYRLANYKKGGELIESYNQGGQAEVEKLIREQFGVLMYADGKG
QAINRAEYLRWKFRDLEQVVLPIEASLSQFDPLAQWNDHEACWQMQYRGSLGETLLHVLIICDTRIHTRLARILLKC
FPRLAIDVVEGEEYLGASALHLAIAYNNNELVQDLVEAGAIISQRAIGSFFLPRDQQRTNPAKNTDYEGLAYLGEYP
LAWAACCANESVYNLLLDSGADPDEQDSFGNMILHMVVVCDKLDMFGYALRHPKLPARNGIVNAAGLTPLTLACQLG
RAEVFREMLELSAREFWRYSNITCSAYPLNALDTLLPDGRTNWNSALFIILNGTKEEHLDMLDGGIIQRLLEEKWKT
FARLQFLKRLIILVFHLTSLSLAVYMRPSNIDATLLEWPEEITEVGRMIAECTTVIGVLSYILVQLGGEVVNIGLLS
FMKQLSHEPAKLIFLISNLLILACIPCRLAGNRHAEDAILVVAVPGSWFLLMFFAGAIRLTGPFVTMVYSMITGDML
TFGIIYMVVLFGFCQSFYFLYKGFPGVKSSLYSSYHSTWMALFQITLGDYNYTDLGYTTYPNLSKMVFAIFMVLVPI
LLLNMLIAMMGNTYAHVIEQSEKEWVKQWAKIVVSLERAVAQKDAQNYLQEYSIKLGPGDDPNNPASEQRGVLVIKS
KSKTKAKQRKGAVANWKRVGKVTINELKKRGITGEALRRVMWGRASFSTPRDTLRALGSVGIVRAVGTLGPVGTVRA
VGALGPVGTVRDSSMAEDFQDPLLELVIASENTDDPETLLKIAERAAANFEVESSSKINLQILEQFTMTKLPMEEKV
AATKKQYFVESSDNDFGGDNLLGTEARLRRIRSANNRFITTRRRSRHTDDDLSSTSSTSADRNPQYQPLLNGPENLV
SRQIESRESSIEAIKPQVKQNGSCDSVKIKVQKRRPKTAKNRVSPKEIEEAGPRRRESIERNKAVSPATSPTDPLEP
WSTRGIKDMNTILAWEENTPDSP

FIGURE 101 - SEQ ID NO: 96

<> 96
<> 949
<> PRT
<> Dendroctonus ponderosae
<> ERL85467.1
<> ?
>gi|546673959|gb|ERL85467.1| hypothetical protein D910_02886 [Dendroctonus
ponderosae]
MGGCQCKPCCKHKKSHYTGGSILDRVISQSSNQDQCLLYRLANYKKGGELIDAYNAGGQIECEKLIRDQFAQLMYQD
GKGKIINRSEYLRWKFRDHEHVILPIEASLSRYDPLGKWTDHEACWQMQYRGSLGESLLHLLIICDSKIHTRLARTL
IKCFPKLALDVVEGEEYLGASALHLAIAYSNNELVQDLVEAGANVNQRAIGKQIADKTGKINAKNRSFFLPRDQQKQ
RPAKHTDYEGLAYLGEYPLAWAACCANESVYNLLLDSGAHPDLQDNFGNMILHMVVVCDKLDMFGYALRHPKLPASN
GIINKAGLTPLTLACKLGRAEVFREMLELSCKEFWRYSNITCSAYTLNALDTLLPDGRTNWNSALFIILNGTKEAHL
DMLDGGIIQRLLEEKWKAFARNQFLKRLIILIVHLAFMSLAVYMRPDDPDEPLLEWSDDPTVIIRFTAEIGTLLNVL
SYVVVQQGDEIRNQGFLSFLKQQTNSPPKCIFLVSNLMILACIPCRLAGNRGLEETILIFAVPGSWFLLMFFAGAVR
LTGPFVTMIYSMITGDMLTFGIIYTIFLFGFSQSLFFLYKGNPSVNGTLYHSYSSTWMALFQVTMGNYDYSELALTT
YPGVAKSVFGLFMVFVPILLFNMLIAMMGNTYAHVTEQSEKEWVKQWAKIVISLERAIPQKEAHNYLQEYSISLGPA
EDPATEQRGVMVIKSKNKTRAKQRKGAVSNWKRVGKVTIKALKKKGMTGEEMRCLMWGRESINTPVKVKGPKRDPLA
NPQGPDLANGFGDALTSALDVMAFTHDLDINAQGLNLAKQTLNPKPFTDPLRTLVLESLVETNSARLSVLAAQAANL
PDTAEIVSCPNTATTSVKNLAGIFAGTGNFVKKIEEKVKKKYAVLECSDSESFGGKCHGISTHFQSKTLKYCRSAA
GDNITGEEGQTDTYATFCKQEKEFR

FIGURE 102 - SEQ ID NO: 97

<> 97
<> 1147
<> PRT
<> Nasonia vitripennis
<> XP_001602588.2
<> ?
>gi|345485102|ref|XP_001602588.2| PREDICTED: hypothetical protein
LOC100118680 [Nasonia vitripennis]
MGGACSCQGRDSQVNAGSILDRVISQASDEDQCLLYRLANYKKGGELIEAYNQGGQAEVERLIREQFGILMYADGKG
QTINRAEYLRWKFRDLDQVILPIEASLSRFDPLAQWSDHEACWQMQYRGSLGETLLHVLIICDTRTHTRIARTLLKC
FPRLAIDVVEGEEYLGASALHLAIAYANNELVQDLVEAGAIVSQRAIGSFFLPRDQQRPRPAKSTDYEGLAYLGEYP
LAWAACCANESVYNLLLDSGAHPDEQDTFGNSILHMVVVCDKLVRFGYALRHPKLPASNGIANAAGLTPLTLACQLG
RAEVFREMLELSAREFWRYSNITCSAYPLNALDTLLPDGRTSXNSALFIILNGTKEEHLDMLDGGIIQRLLEEKWKT
FARLQFLKRLVILVFHLVSLSLAVYFRPADTDAELAQWPEEITDVVRVIAECVTVLGVLGYILLQLGGEIVNIGFFS
FFKQLSHEPAKFIFLISNLLILACIPCRLSGDRHTEDAILVVAVPGSWFLLMFFAGAVRLTGPFVTMVYSMILGDMR
TFGIIYMIVICGFTQAFYFLYKGYPGVKTTLFHSYPSTWMALFQITLGDYSYSDLSMTTYPNLSKAVFTIFMVLVPI
LLLNMLIAMMGNTYAHVIEQSEKEWMKQWAKIVVSLERAVSQDDAHNYLQEYSIKLGPGDDPNDPASEQRGVMVIKS
KSKTRARQRKGAVANWKRVGKVTIAELKKRGMTGEELRRIMWGRASFSTPVRSSPILMEPVSSVPGGFGDALTSALD
VMTFAADVPVPIEGSIPKPVAVAPGQQPTTTLALPNGAAKPQQPMMTTSTTTTTITTTVQKTLVTGTATTPAVGVTK
TVAVPAATTVSTTTTRASASAVPPTVRPSELGPASAPCSADPLLELMLATEDPGSSEETLQRLAHSARIVGESATTS
AKSDIDSSFLERLALGGLGLAAMPEQPDKPVEPKKKQYLVESSDNDICANDGQLGTEARLRRIRSASSRLAPTTTTS
TSRRKSGQQKQQREARDDESTSSAASLDNISGYQPLLNEPDTTADQPATGTEDNKPANGRNLRKRPKTTSNEGKVFC
SRRTIVVLNKNKKNKKLETSEANMNARKKETLLALHDMTSLISGRVLTLEQANENGYEMLEQLKHKLDP

FIGURE 103 - SEQ ID NO: 98

<> 98
<> 1109
<> PRT
<> Camponotus floridanus
<> EFN61724.1
<> ?
>gi|307168692|gb|EFN61724.1| Transient receptor potential cation channel
subfamily V member 6 [Camponotus floridanus]
MGGVCSCRVGRGNQLNAGSILDRVISQASNEDQCLLYRLANYKKGGELIEAYNQGGQPEVEKLVREQFGILMYADGK
GQVINRAEYLRWKFRDLEQVVLPIEASLSRFDPLAQWNDHEACWQMQYRGSLGEALLHVLIICDTRIHTRIARILLK
CFPRLAIDVVEGEEYLGASALHLAIAYNNNELVQDLVDAGAIISQRAIGSFFLPRDQQGMNPVRNTDYEGLAYLGEY
PLAWAACCANESVYNLLLDSGADPDEQDSFGNMILHMVVVGDKLDMFGYALRHPKLPARNGIANAAGLTPLTLACQL
GRAEVFREMLELSAREFWRYSNITCSAYPLNALDTLLPDGRTNWNSALFIILNGTKEEHLDMLDGGIIQRLLEEKWK
TFARLQFLKRLIILVFHLASLSLAVYFRPADTDAVLLQWPEEITDVIRTAAECITVLGVLNYILVQLGGEMINVGPL
SFLKQLSHEPAKLIFVISNLLILACIPCRIAGNRHAEDAILVFAVPGSWFLLMFFAGAIRLTGPFVTMVYSMITGDM
LTFGIIYTIMLFGFSQSFYFLYKGFPGVKSSLYHSYVSTWMALFQITLGDYNYAELNNTIYPNLSKTVFAIFMVLVP
ILLLNMLIAMMGNTYAHVIEQSEKEFVKQWAKIVVSLERAVSQKDAHNYLQEYSIKLGPGDDPNNPASEQRGVLVIK
SKSKTKAKQRKGAVANWKRVGKVTINELRKRGMTGEELRHIMWGRESFSTPVRVSPNAGQPQVSAVTAGFGDALTAA
LDVMAFAHDFDLSAATEGIPTNIDAKQTKTTQSKAIPNDQMKTTQNNPETVTNVQPHKQPIGEPTKLLGLTDLIDNS
IGPVKDVEAMNLKNTNQTKALEASMEFEDPFLELAIASETTTNYEILLQIAKSALAASEASVKTAIDPQILAHFAMI
PPPITEKFIVKKQYFMESSDNDVGGDNLLGTEARLRRIKSANNRFITTSKRPHRDDDGDSSSSTISIERNQRYRPLF
NDPEERSINHVETEGQKTPMETIKSEIQQNGSIPLKPPDKIQKRRPKTAKNRVSPKEIEEPRRRESIEQNKAASPPT
SSSDPLEPWSTRGITDMNTILAWRDNAPDSP

FIGURE 104 - SEQ ID NO: 99

<> 99
<> 998
<> PRT
<> Danaus plexippus
<> EHJ71463.1
<> ?
>gi||gb| EHJ71463.1 hypothetical protein KGM_ [Danaus plexippus]
MGVPLSKLCSATSVPAVGSVLDRVISQPSSEDHTVLYKLADYKKGGLLLETYTKGGVVAAERLIREEFSAYMYAGGR
GRVINRAEYLRWKFRDQEQVVLPIEASLSPHDPLAKWEDHTACWQMSYRGALGESLLHVLIICDTKIHTRLARTLVK
CFPKLSLDVVEGEEYLGASSLHLAIAYSNNELVQDLVEAGADVSQKAIGSFFLPRDQQKNPPARQTNYEGLAYLGEY
PLAWAACCANEAVYNLLLDSGADPDAQDSFGNMILHMVVVCDKLDMFGYALRHPKVPASNGRLNKAGFTPLTLACQL
GRASVFREMLELSSREFWRYSNITCSAYPLNALDTLLPDGRTNWNSALFIILNGTKQEHLNMLDGGIIQRLLEEKWK
TFARTKFLKRLLILMLHLILLSISVYLRHSSLEADVDPDWGLEVNDARSGIRLACELGTIISTLCYIILQQGDEIKN
QGVVAYFKQLIHEPAKFIFLASNILLLACIPARISQRTTLEEAILIFVLPGSWFLMMFFAGAVKLTGPFVTMIYSMI
TGDMFTFGIIYCIVLFGFSQSFYFLYKGFPNVHSTLYSSYPSTWMALFQITLGDYSYTDLGLTMYPNLSKTVFTVFM
VFVPILLLNMLIAMMGNTYAHVIEQSEKEWVKQWAKIVVSLERSVSQEDAHRYLQEYSIGLGPSDDPRYEQRGVMVI
KSKAKTRAKQRKGALSNWKRVGKVTIAELRRRGISGEELRRLMWGRVSISTPTKAPLKCVPPPELVTSEIPGSGVGP
ALSSALNVMAYTQDLDLTNTGSELHKQITPDLLVNGKTPVTAQNTATTPKVPLVNLPNKAGLDVQSTGSDQSVPTAL
TKNMDVLGINMSTQDLLKNQTINNPATANEIVFKDYLRDIIKAEQLGLDNIDIKALAEKAANLTDVPEIDINISTAA
RSARRVVAGAVSGLFGVTAETPRDAGWRRERHEHTDSDPVPECVILGRAARARRARSASRRAPPPPPHLYVPAR

FIGURE 105 - SEQ ID NO: 100

<> 100
<> 1179
<> PRT
<> Bombyx mori
<> XP_004925321.1
<> ?
>gi|512902216|ref|XP_004925321.1| PREDICTED: uncharacterized protein
LOC101737437 [Bombyx mori]
MGNAIGKFLTAGNVQGAGSVLDRVISQPSSEDHTVLYKLADYKKGGLLLETYAKGGMTAAEKLMRDEFAAYMYGGGR
GRVINRAEYLRWKFRDQEQVVLPIEASLSPYDPLAKWEDHTACWQMCYRGALGESLLHVLIICDTKIHTRLARTLVK
CFPKLSLDVVEGEEYLGASSLHLAIAYSNNELVQDLVEAGADVNQRAIGSFFLPRDQQRVPPARQTNYEGLAYLGEY
PLAWTACCANEAVYNLLLDSGADPDAQDSFGNMILHMVVVCDKLDMFGYALRHPKVPASNGRMNKAGFTPLTLACQL
GRASVFREMLELSAREFWRYSNITCSAYPLNALDTLLPDGRTNWNSALFIILNGTKQEHLNMLDGGIIQRLLEEKWK
TFARTKFLKRLLILMLHLILLSVSVYLRHSSAEADAHPNWGLEINDARSGLRLASELGTILSTLCYIILQQGDELKN
QGLVAYFKQLIHEPAKFIFLASNILVLACIPARLLKETNVEEAILLFLLPGSWFLLMFFAGAVKLTGPFVTMIYSMI
TGDMFTFGIIYCIVLFGFSQSFYFLYRGFPNVQSTLYSSYPSTWMALFQITLGDYSYSDLSQTTYPNLSKTVFTVFM
IFVPILLLNMLIAMMGNTYAHVIEQSEKEWVKQWAKIVVSLERSVAQDDAHKYLQEYSIGLGPSDDPRYEQRAVMVI
KSKAKTRAKQKKDALTNWKHVGKVTIAELRRRGISGEELRRLMWGRISISTPTKAPLPRRVPAPPPDCVVSSDVGLA
SDVGNGVAPALSSALNVMAFTHELDIGTTGSDQKQTTPDLLVNGKTSNAPILTTGTQMPKVSSKTLGTPVARIEASS
LKTPLDVKLNPTTLTQSTVQGNIGNVNIPISGVKITTNVGQNSAVVPEIQQSNENQKPEQVHQDYLRELIVLAEKPA
TTNLELKQLAEKAADLRDVPEIDININMAAKSARKMVAGAVSGLFGVAADTPAPDAGWRRDRHDNSDSDPISESVLL
SRASRARRARSASRRAAPPPPHLYVPARSMYLVASESSAIESDAPWDDQPSSENNSAVGGRREEIAHIKAARPLCIQ
HAASGRTAQVEHSLFVVGPGTGAEVESTPTVQKSEKKARPKTTRSRRNRISPTPVQEAGSPLEPWATAQLSKLSRLI
RYSSSSAASITSQTSTEQEQSPRY

FIGURE 106 - SEQ ID NO: 101

<> 101
<> 993
<> PRT
<> Acyrthosiphon pisum
<> XP_001950096.1
<> ?
>gi|193656992|ref|XP_001950096.1| PREDICTED: transient receptor potential
cation channel subfamily V member 6-like [Acyrthosiphon pisum]
MGNSCASCTDFSFSKTASGSVLDRVISQASNEDDCLLYKLADYKKGGELINVYNNGGQDEAERFIVEKLPGLMYNNG
KGQVINRNDYLRWKFQNRKHVAVNVEERPGPHDPLTRWVDHVACWQMQYRGSLGESLLHVLIICDTVIHTRLSRLLL
KHYPMLSQDVVEGEEYLGASALHLSIAYNNNDLIQDLVDAGANICQRAIGSFFLPRDQQNKEINNKHTDYEGLAYLG
ELPLAWAACCGNQTVYNLLIDAGANPDAQDSFGNMILHMVVVCDKLSMFGYALKHPKVKASNGIMNVAGLTPLTLSC
KLARTSVFREMLELSAREFWRYSNITCSAYPLSALDTLLPDGRTNWNSVLFIILDGTKEEHLDMLDGGIIQKLLEEK
WKTFARKQFMKRLVILSIHLIMLSISIYLRPVDQDKPLLGEAEDWQDVARYCFEGGTVVGVLSYLIVQQGGEILNQG
LVGFLKQTFKEPAKLIFLISNLLILACIPPRMMGDKQTEEAILVFAVPGSWFLLMFFAGAIRLTGPFVTMVYLMITG
DMLTFFVIYSVILSGFTQSFFFLYKGSPDVSTSLYKSYPSTWMALFQITMGDYNYADLSYTVYPALSKTVFTVFMVL
VPILLLNMLIAMMGNTYAHVIEQSEKEWMKQWAKIVVTLERAVPQKAARNYLEEYSIQLAPGDDVNPEQRGFMVIKC
KSQTRAKQRKGAVINWKKSGKLVIQELRRLEGTGQNLRDMIWKRSSLSASSPVAKSVSITKNKSKSYSEAKDDQIRL
SGALGAALDAIAVAHDLDMTLTKDQSIDELHDPLRQLVIMSESDKNIDKSQVEIVANAAAKIANQDSIKPISINLEQ
QNDVKNEKTKIPTSSNTITNRKLLNKQSKNLSMYGFESQDMSVDKYSKAIAITRSISTQTGGIGIIEKNERQIIRPK
TAKINRVTPTQNFAVKRGQSAQPDKREDHRDNKEQQCYCISGNNMLRPWSTQDLAPLNTIMAWGPNDDF

FIGURE 107 - SEQ ID NO: 102

<> 102
<> 275, partial
<> PRT
<> Solenopsis invicta]
<> EFZ13594.1
<> ?
>gi|322787506|gb|EFZ13594.1| hypothetical protein SINV_13786 [Solenopsis
invicta]
MGGACSCRFGRGSQVNPGSILDRVISQASNEDQCLLYRLANYKKGGELIEAYNQGGQPEVEKLIREQFGILMYADGK
GQTINRAEYLRWKFRDLEQVVLPIEASLTRFDPLAQWNDHEACWQMQYRGSLGETLLHVLIICDTRMHTRIARILLK
CFPRLSIDVVEGEEYLGASALHLAIAYNNNELVQDLVEAGAIISQRAIGSFFLPRDQQRMNPARNTDYEGLAYLGEY
PLAWAACCANESVYNLLLDSGADPDEQDSFGNMILHMVVVGDKL

FIGURE 108 - SEQ ID NO: 103

<> 103
<> 142
<> PRT
<> Schistocerca americana, DNA partial
<> In-house
<> ?
> Schistocerca americana, DNA partial
SWFLLMFFAGAXRLTGPFVTMVYSMITGDMLTFGIIYTVVLFGFSQSFYFLYKGFPGVKTSLYHSYPTTWMALFQIT
MGDYNYPELSHTTYPTLAKTVFAIFMVLVPILLLNMLIAMMGNTYAHVIEQSEKEWMKQWAKIVV

FIGURE 109 - SEQ ID NO: 104

```
<> 104
<>
<> PRT
<> Myzus persicae
<> In-house
<> ?
```
ERPGPHDPLTRWVDHVACWQMQYRGSLGESLLHVLIICDTVIHTRLSRLLLKHYPMLSQDVVEGEEYLGASALHLSI
AYNNNDLIQDLVDAGANICQRAIGSFFLPRDQQNKEINNKHTDYEGLAYLGELPLAWAACCGNQTVYNLLIDAGANP
DAQDSFGNMILHMVVVCDKLSMFGYALKHPKVPASNGIMNVAGLTPLTLSCKLARTSVFREMLELSAREFWRYSNIT
CSAYPLSALDTLLPDGRTNWNSVLFIILDGTKEEHLDMLDGGIIQKLLEEKWKTFARXXXXXXXXXILSIHLIMLSIS
IYLRPVDQDKPLLGEAEDWQDVARYCFEGGTVVGVLSYLIVQQGGEILNQGLVGFLKQTFKEXXXXXXXXXXXXXXX
XXXXXXXXXXXXXXXXXXXXXXXXXXXXXXXXXXXXXXXXXXXXXXXDMLTFFVIYSVILSGFTQSFFFLYKG
SPDVSTSLYKSYPSTWMALFQITMGDYNYADLSYTVYPALSKTVFTVFMVLVPILLLNMLIAMMGNTYAHVIEQSEK
EWMKQWAKIVVTLERAVPQKAARNYLEEYSIQLAPGDDVNPEQRGFMVIKCKSQTRAKQRKGAVINWKKSGKLVIQE
LRRLEGTGQNLRDMIWKRSSLSASSPVAKSVSITKNKSKSYSEAKDDQIRLSGALGAALDAIAVAHDLDMTLTKDQS
IDELHDPLRQLVIMSESDKNIDKSQVEIVANAAAKIANQDSIKPISVNLEQXXXXXXXXXXXXXXXXTITNRKLLNKQ
SKNLSMYGFESQDISVDKYSKEIVITRSISTQTGGIGIIEKNERPIIRPKTAKINRVTPTQNFAVKRGQSAQPDKRE
DHRDNKEQQCYCISGNNMLRPWSTQDLAPLNTIMAWGPNDDF

FIGURE 110 - SEQ ID NO: 105

```
<> 105
<> 552
<> PRT
<> Bemisia tabaci
<> In-house
<> ?
```
MYNDGKGQIIKRAEYLRWKFRDQQQVTLPIEASLSPHDPLAKWEDHEACWQMQYRGSLGETLLHVLIICDTKTNTRL
ARTLLKCFPRLAQDIVEGEEYLGASALHLAIAYNNNELVQDLVEAGANVNQRAIGSFFLPKDQQRPRPAKHTDYEGL
AYLGEFPLSWAACCANESVYNLLLDSGAHPDMQDTFGNMILHMVVVCDKLDMFGYALRHPKLPASNGITNTAGLTPL
TLACKLGRAEVFREMLELSAREFWRYSNITCSAYPLNALDTLLPDGRTNWNSALFIILNGTKEEHLDMLDGGIIQRL
LEEKWKTFARRQFLKRLAILFLHLLMLSMAVYLRPVDREQPLIGGDDWSDIARYGFEVGTIMGVLSYLVVQQGGEIK
NQGLGSFLKQLMAEPAKAIFLVSNLLILACIPFRMAGDSQTEEAILILAVPGSWFLLMFFAGAVRLTGPFVTMIYSM
ITGDMFTFGIIYSILLFGFSQSFYFLYKGSPNVKQTLFHSYPTTWMALFQITLGDYNYPELAFTVYPTLSKIVFTSF
MVLVPILLLNMLIAMMGNTYAHVIERSEKEWMKQWAKIVVALERAVPAADAHNYLQEYSIKLGPGDDPSTEQRGVMV
IKSKSKTRAKQRKGAVSNWKRVGKVTINELRKRGMTGEQLNRIMWGRASISTPVRQPAMALLLEDSEEENAANNTGP
FGGALTAALDVMAFTHDIDLNIGQTPVTVSGLGGVSVRSGAEGLPPEQPFHDPFRQLVIEAENPHIDESELAALANA
AAMSVVAPDDIPTPVVTPEPVSALPRLPSLHLEPSDSDGLGDGPLLGRGSRVRRVRSAHLKQQKASSTNGNGYSDRQ
RLFSSKNEDSSSNTSLDFDLTNPPSQLRLTPPPRPVTAEIVAVNPKKYIGGNSQERLRPKTAKVNRVAPTPDVPVRR
GISANGIPESLPSPPDPLEPWSTRNIVNMNAILAWQQSDQDSL

FIGURE 111 - SEQ ID NO: 106

```
<> 106
<> 984
<> PRT
<> Euschistus heros
<> In-House
<> ?
```
MGIIWGSGASSVNAGTVLDRVISQASNKDECLLYKLANYKKGGELIDAYNAGGQSEVEKLIREQFGQLMYNEGKGAL
INRAEYLRWKFRDMQQVQIPIEASLSSQDPLSKWEDHQACWQMQYRGSLGETLLHVLIICDTKIHTRLARTLLKCFP
NLAIDVVEGEEYLGASALHLAIAYFNNELVQDLVEAGANVEQRAIGSFFLPRDQQGQRPSKHTDYEGLAYLGEYPLA
WAACCANESIYNLLLDNGANPDHRDTFGNMILHMVVVCDKLDMFGYALRHPKMPASNGIANVAGLTPLTLACKLGRA
KVFREMLELSAREFWRYSNITCSAYPLNALDTLLPDGRTNWNSALFIILNGTKEEHLDMLDGGIIQRLLEEKWKXFA
RRQFLKRLVILMLHLLCLSGAVYLRPTDRTKPLLGGDDWKSVARQGFEVATVLGVLSYVIVQQGGEIRNQGFISFIK
QLDXAKAIFLVSNILILICIPFRLMDDKRTEEAILVFAVPGSWFLLMFFAGAVRLTGPFVTMVYSMIVGDMFTFGII
YSIVLFGFSQSFYFLYKGFPGVKNTLYSSYHSTWMALFQITLGDYNYAELSHTSYPTLSKTVFAIFMILVPILLLNM
LIAMMGNTYAHVIEQSEKEWMKQWAKIVVSLEXAVNQEDCKQYLQEYSIKLGPGDDPSTEQRGVMVIKSKSKTRAKQ
RKGAVANWKRVGKVTINELRKRGMNGEQLRRIMWDRASISTPVKVPQNPVVDVLMENTAEQQAQQTPGSFGGALTAA
LDVMAFTHDLDLSASGITSSGLNAKELIVSDPFRDLVLSSEIDVGEEELATLAEAAVLSVMSGQSDESEKLKIAKFN
KQISFEQNAVLEVSDSDGFLDGQPLGQGSRARKVKSAQERQRAERTWGGTSISSIEEPPPYLPLPPPPPLHSHQRPR
PKTAKPNRVVPEAVVAKRPQSSALGDRVKSPPELLEPWSTRGIATINTILAWQPSDQDSM

FIGURE 112

FIGURE 112 - CONTINUATION

```
                          101                                            150
         nan-Aaeg  (101) EE    AVCP  TEG----------  YQRNP GY REV WN K  GAVG
         nan-Cqui  (101) EE    K CP  TEG----------  YMRNPGGY REV WN KERGAVG
         nan-Adar  (101) EE    AVCP  SEA----------  YYLNP GY REV WN KE GAVG
         nan-Agam  (101) EE    AVCP  SEA----------  YYLNP GY REV WN KE GAVG
         nan-Ccap  (101) DE  N   HCT  SEA----------  YISNP A RYV WNLN  GAVG
         nan-Mdom  (101) DE  N  DYCS  SEA----------  YISNP A RFV WN N   A G
         nan-Dmel  (101) DD  N  DYCP  SEA----------  YISNP A  FV WDLNM GA G
         nan-Aech  (101) -A    K MG EEV----------  D AKIDK KY RL WNLS RGAVG
         nan-Sinv   (70) -A    K MG EEV----------  D AKIDK KY RL WNLS RGAVG
         nan-Cflo  (101) -A    K MG EEV----------  D TKIDK KY RL WNLS RGAVG
         nan-Hsal  (101) -A    K MG EDV----------  D TKIDK KY RL WSLS RGAVG
         nan-Aflo  (101) -A    K TG DEVR---------  D TRIDK KY RL WSLS RGAVG
         nan-Amel  (101) -A    K MG DEV----------  D TKIDK KY RL WSLS RGAVG
         nan-Mrot  (101) -A    K MG EEV----------  D TKIDK KY RL WS S  GAVG
         nan-Nvit  (101) -E    K MANDPEPDENTIGMMIM ILSNK KY KL WTLS RGAVG
         nan-Apis  (101) -N    K IPT  EEL----------EKLGEVQ  REV WDLK RGT GE
 nan-Mper partial   (48) -N    K IPT  EEL----------EKLGEVQXXXXXXXXXXXXXXX
 nan-Nlug partial    (1) --------------------------------------------------
         nan-Bmor  (101) DE    K WPV  TQE----------  YDANP GY RE WD K RGAVG
nan-Btab_partial    (1) -------------------------DPEKIDPKKC RE WDLM RGAVG
         nan-Dple   (75) DE    K WPV  TQE----------  YEANP A RE WD K RGAVG
 nan-Eher partial    (1) --------------------------------------------------
         nan-Phum  (101) ES M R GNPGDFQPAPDG--VQE FHDYN K DV WD KK RGAVG
 nan-Same partial    (1) --------------------------------------------------
         nan-Dpon  (101) -E    D GP  TE----------E YNKDP L  HV WK R RGAVG
         nan-Tcas  (101) -E    D GP  TE----------EQYQKNPHL  HV WK K  GAVG 151                                            200
         nan-Aaeg  (141)
         nan-Cqui  (141)
         nan-Adar  (141)
         nan-Agam  (141)
         nan-Ccap  (141)
         nan-Mdom  (141)
         nan-Dmel  (141)
         nan-Aech  (140)
         nan-Sinv  (109)
         nan-Cflo  (140)
         nan-Hsal  (140)
         nan-Aflo  (141)
         nan-Amel  (140)
         nan-Mrot  (140)
         nan-Nvit  (150)
         nan-Apis  (139)
 nan-Mper partial   (86) XXXXXXXXXXXXXXXXXXXXXXXXXXXXXXXXXXXXXXXXXXXX
 nan-Nlug partial    (1) --------------------------------------------------
         nan-Bmor  (141)
nan-Btab_partial   (26)
         nan-Dple  (115)
 nan-Eher partial    (1) -------------------
         nan-Phum  (149)
 nan-Same partial    (1) --------------------------------------------------
         nan-Dpon  (140)
         nan-Tcas  (140)
```

FIGURE 112 - CONTINUATION

```
                         201                                                250
         nan-Aaeg  (191) EDRAMVKYLLDSGSD----VNERCCGTFMCPELQKATRYDSIETEILCXL
         nan-Cqui  (191) EDRAMVKYLLDAGSD----VNERCCGTFMCPELQKASRFTSSRTEILCYM
         nan-Adar  (191) EDRAMVKYLLDHNSD----VNERCCGTFMCPELQKASRYLTPRTEVVCNV
         nan-Agam  (191) EDRAMVKYLLDHNAD----VNERCCGTFMCPELQKASRYLTPRTEVVCNV
         nan-Ccap  (191) EDRAMVKYLLAGAD-----VQERCCGAFMGALLQKASRYLSPLHLYGVQ
         nan-Mdom  (191) EDRAMVKYLLDANAD----VQERCCGAFMSAELQKASRYDSPETEYGYH
         nan-Dmel  (191) EDRAMVKYLLDANAD----VQERCCGAFMSAELTKFSRTDSPLHEYVALC
         nan-Aech  (190) EDRSMVKFLLDSGADDPCIEHERCFGNFMCPELQKASRFDNMDHEWVCVS
         nan-Sinv  (159) EDRSMVKFLLDSGADDPRIEHERCFGTFMCPELQKASRFTSMDHEWVCYT
         nan-Cflo  (190) EDRSMVKYLLDSGADDPRIEHERCFGNFMCPELQKASRFTSQDIEWVCYT
         nan-Hsal  (190) EDRAMVKYLLDSGAD----VHERCFGNFMCPELQKASRVDSSDHEWVCVA
         nan-Aflo  (191) EDRSMVKFLLDSGAD----VHERCIGRFMCPELQKASRADSSDHEWVCYT
         nan-Amel  (190) EDRSMVKFLLDSGAD----VHERCIGNFMCPELQKASRADSSDHEWVCYT
         nan-Mrot  (190) EDRAMVKFLLDSGAD----VHERCVGNFMCPELQKASRTDSVDHEWVCVA
         nan-Nvit  (200) EDRSMVKFLLDSGAN----VNERCCGNFMCPELQKASRNDSVEREWVCYC
         nan-Apis  (189) EDRAMVKVLNLDGGAN----KNERCFGNFMSTELQKASRSLSSDHEWVNSC
    nan-Mper partial (136) XXXXXXXXXXXXXX----XXXXXXXXXXXXXXXXXXXXXXXXXXXX
    nan-Nlug partial   (8) EDRSMVKFLINSGAD----FHERCFGNFMCPELQKASRSDSFDHEWVNLW
         nan-Bmor  (191) EDRTMAKFLLDAGAD----YHERCYGNFMCPELQKASRTDSFDHEWVNVQ
    nan-Btab_partial  (76) EDRAMVKFLLDSGAD----YHERCTGNFMCPELQKATRQINVHLEWVNES
         nan-Dple  (165) EDRTMVKFLLDSGAD----YHERCFGNFMCPELQKASRTDSFDHEWVNNQ
    nan-Eher partial  (30) EDRAMVKFLLDSGVN----VNERCFGNFMCPELQKASRTDSSDHEWVNSQ
         nan-Phum  (199) EDRAMVKFLLDSGSN----FHERCFGNFMCPELQKATRTDSSDHEYVNES
    nan-Same partial   (8) EDRAMVKFLLDSGAN----VHERCFGTFMSPELQKAQRSDSSDHEWVNVN
         nan-Dpon  (190) EDRSMVKFLIAAVN-----FQERCFGNFMCPELQKSSRTTDSSDHEWVNYY
         nan-Tcas  (190) EDRSMVKFLLDSGVN----VQERCCGNFMCPELQKSSRYDSSDHEWVNVC 251                                                300
         nan-Aaeg  (237) EMTNYDGYVYWGEYPLSFAACLGQEECYRLVLARGADPDNQTSNGNTVLH
         nan-Cqui  (237) EQINYDGYVYWGEYPLSFAACLGQEECYRLVLARGADPDNQSNMNNVLH
         nan-Adar  (237) QLINYDGYVYWGEYPLTFAACLGQEECYRLVLARGADPDNKDFNGNTVLH
         nan-Agam  (237) QVINYDGYVYWGEYPLTFAACLGQEECYRLVLARGADPDNKDFNGNTVLH
         nan-Ccap  (237) EMINYDGYVYWGEYPMSFAACLGQEDCFRLVLARGADPNLQTNGNTSLH
         nan-Mdom  (237) EMINYDGYVYWGEYPLSFAACLSQEECFRLVLARGADPDSQTNGNTVLH
         nan-Dmel  (237) EMINYDGYVYWGEYPLSFAACLSQEECFRLVLARGADPDFQTNGNTVLH
         nan-Aech  (240) ERTNYNGYVYWGEYPLSFAACLGQEECYRLILARGADPDKQTNGNTVNH
         nan-Sinv  (209) ESTDYNGYVYWGEYPLSFAACLGQEECYRLILARGADPDKQTNGNTVLH
         nan-Cflo  (240) ERTNYNGYVYWGEYPLSFAACLGQEECYRLILARGADPDKQTNGNTVLH
         nan-Hsal  (236) ERINSGYVYWGEYPLSFAACLGQEECYRLMLARGADPDKQDTNGNTVLH
         nan-Aflo  (237) ERTNYNGYVYWGEYPLNFAACLGQEECYRLILARGADPDKQDTNGNTVLH
         nan-Amel  (236) ERINYNGYVYWGEYPLNFAACLGQEECYRLILARGADPDKQDTNGNTVLH
         nan-Mrot  (236) ERINSGYVYWGEYPLNFAACLGQEECYRLILARGADPDKQDTNGNTVLH
         nan-Nvit  (246) SETNIDGYVYWGEYPLSFAACLGQEECYRLILARGADPDSQDTNGNTVLH
         nan-Apis  (235) PDTNYEGYVYWGEYPLSFAACLGQEESYRLMLARGADPNQDTNGNTVLH
    nan-Mper partial (182) XXXXXXXXXXXXXXXXXXXXXXXXXXXARGADPNQDTNGNTVLH
    nan-Nlug partial  (54) EVINYEGYVYWGEYPLSFAACLGQEECYRLMLARGANPDNQDTNGNTVLH
         nan-Bmor  (237) EDTNYNGYVYWGEYPLSFAACLGQEECYRLILARGADPDKQDTNGNTVLH
    nan-Btab_partial (122) ELINYEGYVYWGEYPLSFAACLGQEECYRLMLARGADPDNQTNGNTVLH
         nan-Dple  (211) EDTNYDGYVYWGEYPLSFAACLGQEECYRLILARGANPIKQDTNGNTVLH
    nan-Eher partial  (76) SFITNSGYVYWGEYPLSFAACLGQEEXYRLMLARGANPDNQDTNGNTVLH
         nan-Phum  (245) IEINYEGYVYWGEYPLSFAACLGQEESYRLMLARGANPDNQDTNGNTVLH
    nan-Same partial  (54) SDINYEGYVYWGEYPLSFAACLGQEECYRLVLAKGANPDSQDTNGNTILH
         nan-Dpon  (236) HEINYDGYVYWGEYPLSFAACLGQEESFRLILAKGANLDAQDTNGNTVLH
         nan-Tcas  (236) EVINYEGYVYWGEYPLTFAACLGQEESFRLMLSRGADPDAQDTNGNTVLH
```

FIGURE 112 - CONTINUATION

```
                          301                                                350
        nan-Aaeg  (287)   ...
        nan-Cqui  (287)
        nan-Adar  (287)
        nan-Agam  (287)
        nan-Ccap  (287)
        nan-Mdom  (287)
        nan-Dmel  (287)
        nan-Aech  (290)
        nan-Sinv  (259)
        nan-Cflo  (290)
        nan-Hsal  (286)
        nan-Aflo  (287)
        nan-Amel  (286)
        nan-Mrot  (286)
        nan-Nvit  (296)
        nan-Apis  (285)
nan-Mper partial  (232)
nan-Nlug partial  (104)
        nan-Bmor  (287)
nan-Btab_partial  (172)
        nan-Dple  (261)
nan-Eher partial  (126)
        nan-Phum  (295)
nan-Same partial  (104)
        nan-Dpon  (286)
        nan-Tcas  (286)

351                                                400
        nan-Aaeg  (337)   EREIYWQ...AEHLD
        nan-Cqui  (337)
        nan-Adar  (337)
        nan-Agam  (337)
        nan-Ccap  (337)
        nan-Mdom  (337)
        nan-Dmel  (337)
        nan-Aech  (334)
        nan-Sinv  (303)
        nan-Cflo  (334)
        nan-Hsal  (336)
        nan-Aflo  (337)
        nan-Amel  (336)
        nan-Mrot  (336)
        nan-Nvit  (346)
        nan-Apis  (335)
nan-Mper partial  (282)   EREIYWQ...XXXXXXXXXXXXXXXXXXXXXXXXXXXHLE
nan-Nlug partial  (154)
        nan-Bmor  (337)
nan-Btab_partial  (222)
        nan-Dple  (311)
nan-Eher partial  (176)
        nan-Phum  (345)
nan-Same partial  (154)   EREIYWQIG---------------------------------------
        nan-Dpon  (336)
        nan-Tcas  (336)
```

FIGURE 112 - CONTINUATION

```
                          401                                               450
       nan-Aaeg    (387)  [shaded]                                     M---
       nan-Cqui    (387)  [shaded]                                     M---
       nan-Adar    (387)  [shaded]                                     P---
       nan-Agam    (387)  [shaded]                                     P---
       nan-Ccap    (387)  [shaded]                                     ----
       nan-Mdom    (387)  [shaded]                                     KI--
       nan-Dmel    (387)  [shaded]                                     ----
       nan-Aech    (384)  [shaded]                                     STIE
       nan-Sinv    (353)  [shaded]                                     STME
       nan-Cflo    (384)  [shaded]                                     ---Q
       nan-Hsal    (386)  [shaded]                                     -LPQ
       nan-Aflo    (387)  [shaded]                                     ATTS
       nan-Amel    (386)  [shaded]                                     ATTS
       nan-Mrot    (386)  [shaded]                                     SVTS
       nan-Nvit    (396)  [shaded]                                     ----
       nan-Apis    (385)  [shaded]                                     PPTG
  nan-Mper partial (332)  [shaded]                                     PPTG
  nan-Nlug partial (204)  [shaded]                                     PEAH
       nan-Bmor    (387)  [shaded]                                     PD--
  nan-Btab_partial (272)  [shaded] XXXXXXXXXXXXXXXXXXXXXXXXXX
       nan-Dple    (356)  ------------------------------------------------
  nan-Eher partial (226)  [shaded]                                     PPVK
       nan-Phum    (395)  [shaded]                                     P---
  nan-Same partial (163)  ------------------------------------------------
       nan-Dpon    (386)  [shaded]                                     --------
       nan-Tcas    (386)  [shaded]                                     ----

451                                               500
       nan-Aaeg    (434)  ------------------------------------------------
       nan-Cqui    (434)  ------------------------------------------------
       nan-Adar    (434)  ------------------------------------------------
       nan-Agam    (434)  ------------------------------------------------
       nan-Ccap    (433)  ------------------------------------------------
       nan-Mdom    (435)  ------------------------------------------------
       nan-Dmel    (433)  ------------------------------------------------
       nan-Aech    (434)  TDEN------ANDTSTRTNSSNITEPIIHKTLQSSDLSELVTNSLVAAFT
       nan-Sinv    (403)  TDEN------ANDTSTKTNSSNITEPIILKPLQSSDLSELVTNSFVAAFA
       nan-Cflo    (431)  TDEN------ANDTLTNSFN-TTRESMILKSLHSSDLSELVTNSFTAAFT
       nan-Hsal    (435)  ETEN------ANDTRTNSSN--ATAMEILRLFQSSDLSNLVTNSLAAAFA
       nan-Aflo    (437)  SVPNPVAQTPLTSTELSTISPKVDPPVSNVTVNRSSNAFQHDSNLSLLLD
       nan-Amel    (436)  ------------------------------------------------
       nan-Mrot    (436)  --------TATTAPTTESTTPKLPDPPPN-FIPVTNQKTFLEASLSSSLD
       nan-Nvit    (442)  ------------------------------------------------
       nan-Apis    (435)  LKPPLINYTSTSTT----------------------------------
  nan-Mper partial (382)  LKPPLINYTSTSTTVATTPFDFMDNESMLPDNV------MYDEMMIGGGG
  nan-Nlug partial (254)  DGMNITANATLNLSFGVLEVRPEALQALLYRLEKLSLPQSGDLERFILES
       nan-Bmor    (435)  ------------------------------------------------
  nan-Btab_partial (322)  XXXXXXXXXXXXXXXXXXXXXXXXXXXXXXXXXXXXXXXXXXXXXXXXXX
       nan-Dple    (356)  ------------------------------------------------
  nan-Eher partial (276)  PISSFNSTKPS-GNNITAELSPESNATTVPKWIYKTEIKKYDPEDNSSQN
       nan-Phum    (442)  ------------------------------------------------
  nan-Same partial (163)  ------------------------------------------------
       nan-Dpon    (428)  ------------------------------------------------
       nan-Tcas    (432)  ------------------------------------------------
```

FIGURE 112 - CONTINUATION

```
                          501                                           550
         nan-Aaeg  (434)  -----------------------NLEETAANRTTTSITLKNLTFSDSTNA
         nan-Cqui  (434)  -----------------------KLEDGEANKTTTSIQLKNMTLADLTNA
         nan-Adar  (434)  -----------------------PPEEDDENRAGGGSGNKTSSASKQDLR
         nan-Agam  (434)  -----------------------PAEDDDGKESEAG-GNKTAAVTKEELR
         nan-Ccap  (433)  -----------------------TEKNEDDDDDDADASVEATVTRAANS
         nan-Mdom  (435)  -----------------------EDEDEEGDANDSAGKGNDSTTNARLLY
         nan-Dmel  (433)  -----------------------DAKDEDEDGANSTTAKSDLYRQNGSDS
         nan-Aech  (478)  SNFKSSLN-----MTQESLEK--IQLQVTSNITSALKSILLLTLNENEGI
         nan-Sinv  (447)  SNLKSSLN-----MTQESLEK--IQLQVTSNITSALKSILLLTLNENEGI
         nan-Cflo  (474)  SNFKSSLN-----VTQESLEK--IQLQVTSNVTSALRSILLLTLSNNEDL
         nan-Hsal  (477)  SNLKSSLN-----VTQESLEK--IQLQVTSNITSALKNILPS-LSDNEGI
         nan-Aflo  (487)  KILSTASVKYPWNVTRTRLDK--LKLDIIENLTTALNNLLST----HRDE
         nan-Amel  (436)  ----------------------S-LDIVENLTSALSDMLGT----YRNE
         nan-Mrot  (477)  EIVTNALNLNFPSNATARFDD--LKLDLVTHIMSNLKNILNG----NETK
         nan-Nvit  (442)  ------------------------------ITKTDAPT-------T
         nan-Apis  (449)  --------------------------------------------------
 nan-Mper partial  (426)  P--------------------TEFETPVVTTEMATVNDNATTNNGTGI
 nan-Nlug partial  (304)  LADEKSISEAALENDENRX----------PGWNNSVFSTYETLARDTGY
         nan-Bmor  (435)  ----------------------RALNTTVLNSTIGPNVTDAELVSDVEN
 nan-Btab_partial  (372)  XXXXXXXXXXXXXXXXXXXXXXXXXXXXXXXXXXXXXXXXXXXXXXXXXX
         nan-Dple  (356)  --------------------------------------------------
 nan-Eher partial  (325)  SRLNVILREVILTSLKVED---------------ID----KVVSFSNAEPQ
         nan-Phum  (442)  -----------------------------TGTTTTTNGIVVLNNNNNNI
 nan-Same partial  (163)  --------------------------------------------------
         nan-Dpon  (428)  --------------------------------------------------
         nan-Tcas  (432)  -------------------------------------PHKEA--------

551                                           600
         nan-Aaeg  (461)  -TLPTLLAADVNEKIVQFIAN------------------------ETLF
         nan-Cqui  (461)  STLSSLLVTDVSGKIVGLNGS------------------------ETFF
         nan-Adar  (461)  QRLWNRTVTLEDADNVSSLLSDIMGIDALGKLA----EQLLNGSEGSGAF
         nan-Agam  (460)  RQLWNETTLEDALAALAGNGS------FAGRLS----NLEQSNGSSDAMG
         nan-Ccap  (460)  TAPLQRGDQWFKRLIKRAIDKMEYKTFWLN-------------FTDYFD
         nan-Mdom  (462)  ATPASR---------VTGIEKLPYKTFWLN-------------FSEYID
         nan-Dmel  (460)  YHLHSK---------RATMTTEYKTFWLN-------------FTEYYD
         nan-Aech  (521)  LSPPDEATIHTLWYTDSPPNASDYFMNTYNKT---DANSTVKTIIDGVAR
         nan-Sinv  (490)  LSPPDEATIHTPWYTDSSPNTSDYFTDLYNKTV-VAENSTVKAVVDDVAQ
         nan-Cflo  (517)  LSSPDEAAIHTLWYTDNPQNASDYFINMYNKTVTIDTNSTAKTTIDDVTL
         nan-Hsal  (519)  LSAPDEAAIRTLWYTSSPYNESDYLTDAYNENVTSDANSTAGTIIGSIEV
         nan-Aflo  (531)  IEFFNHSYKTTEYFHSTRNDTTPIDNLKITINE--TVLSVNSTILFNDGI
         nan-Amel  (458)  IKLFNRSDKTSIYSS--RNDAKPID---------------ETIFFPSYF
         nan-Mrot  (521)  NEPFNSSQLARFDKHLFRENDTDYSTSILNETA--DVDSTTKFSFDNSVL
         nan-Nvit  (451)  --TPHPMNDTSLYADVNETSASDPF---------DLNASDIVILKKGKK
         nan-Apis  (449)  --------------------------------------------------
 nan-Mper partial  (454)  IRTPLIYEDGAGGGGGSGTVSLHGKSSGSDRGKHRSTWNPANHTFKTNYT
 nan-Nlug partial  (343)  QTDESPHDGLSSSMDYAEVAERLTKLMIDVNLTERSGAVNEIILKALPSL
         nan-Bmor  (462)  CTMTPNADFDTNAVEVLNGTKFGGSHCARFKSH----P------KEKSTE
 nan-Btab_partial  (422)  XXXXXXXXXXXXXXXXXXXXXXXXXXXXXXXXXXXXXXXXXXXXXXXXXX
         nan-Dple  (356)  --------------------------------------------------
 nan-Eher partial  (357)  DNSREDADGLVCNGDSVHSCLGNGSDVVAVFGKGKSPKVPK------PGA
         nan-Phum  (462)  TSVVDN--------S-----------------------NNVTT
 nan-Same partial  (163)  --------------------------------------------------
         nan-Dpon  (428)  --------------------------------------------------
         nan-Tcas  (437)  -------KLVNVTINATVSNTSKWE-------------NLTSIPFGKTPD
```

FIGURE 112 - CONTINUATION

```
                         601                                                650
         nan-Aaeg  (485) DPAVMEEN---TFFNSK AT AYD LQD    V         FLY
         nan-Cqui  (486) DPSTIESD---MFFNSK PT IYKGIE   R V         FLY
         nan-Adar  (507) KPETVEEEEDGLFFNSK  T YDGVEG   F V         FLY
         nan-Agam  (500) EFDPAEMDDEGLFFNSN  T YDGVEG     I         FL
         nan-Ccap  (496) DN-DVESVPP WASYA  P  N ME DL    VA    FF   VLY
         nan-Mdom  (489) DDANAENMPS WASYE  P  M ME NL    VS    FF   ILY
         nan-Dmel  (486) PS-EVEVLPA WESYA  P   E DL    MA   NFV   ILY
         nan-Aech  (568) P--KFKSNY  DDFSE  R M  S MSA  R TA   F F   AVLY
         nan-Sinv  (539) ------TDY  DDFAE  R M  T TSA  R TA   F Y   AVLY
         nan-Cflo  (567) LGKFNNHEK  DDLTE  R M I T MSA  R TA   V Y   AVLY
         nan-Hsal  (569) S-KSNDKDN  EDLTE  R M  L T ISA  R TA   M E   AVLY
         nan-Aflo  (579) S-FATGKYN  NNLTE  R M  D LST I  TA   M E   ATLY
         nan-Amel  (490) S-KSLVSNVR NNLTE  R M  D LST I  TA   M E   ATLY
         nan-Mrot  (569) F-EADNKSD  TDLTT  R M  T TASA  R IA   M E   AILY
         nan-Nvit  (489) E-----LDD  DDLTE  R M  N TSA  R TA   F E   AILY
         nan-Apis  (449) -----SRKF  NKRQKV  R MA  S TDDL   GS   GMF   FLY
  nan-Mper partial (504) YNYNKSRKF  NKRQKV  R MA  S TDDL   GS   CMFV  FLY
  nan-Nlug partial (393) EEKEDGLEE  SGIAG   I     LYDLA   CA   LE   FLY
         nan-Bmor  (502) APRENDVEG  EDLTE  R M  D  WQA   R SA  L W    LA  FG
  nan-Btab_partial (472) XXXXXXXXXXXXXXXXXXXXXXXXXXXXXXXXXXXXXXXXXXXXXXXXXX
         nan-Dple  (356) --------------------------------------------------
  nan-Eher partial (401) SADDFDYDDT WEEFG   R   V T YIEMT   I         LY
         nan-Phum  (474) TTATTTATS  SFPGHVIVT   SYDKYED  R IS        VLY
  nan-Same partial (163) --------------------------------------------------
         nan-Dpon  (428) --DDYDVEE  DNLRE  R M  D  TESL   FTA  LG  F   FLY
         nan-Tcas  (467) D-DDSDMEE  DNLQE  R M  E  PES  R TA   M V  FA  A 651                                                700
         nan-Aaeg  (532) R F FLGRK  F EN   I   RVMF  SCC  MM-I   KVL LI   H
         nan-Cqui  (533)      LGRK    N  A   RVMF  SCC  MM-V  C KVL FT   H
         nan-Adar  (557) RELK LGRK  F ENL S--------------------------------
         nan-Agam  (550)    L LGRK  F EN  M A   RVM   SCC  MM-I   KVL FT   H
         nan-Ccap  (545)  E  FLG YK  F VE   M A  RVMF  S   MM-S  W RVF LT   H
         nan-Mdom  (539)  E  FLG YK  F VEN  M A  RVMF  SCC MM-    LS LT   H
         nan-Dmel  (535)  E  FLGLK  F  EN  M A  RVMF  SCA MM-T   RVS LT   H
         nan-Aech  (616)  E  FLGLH  F  EN  T   RVM   SCC  M-W  V  FTS   V  M
         nan-Sinv  (583)  E  FLGLN  F EN  A A  RVMF SCC       R V A   E
         nan-Cflo  (617)  E  FLGLN  F EN  T A  RVMF SCC  M-S  VL  S S  V
         nan-Hsal  (618)  E  FLGLN  F VEN  T A  RVMF SCC   -S   RLA A   V M
         nan-Aflo  (628)  E  FLGLN  F  EN  T A  RVMF SCC   -T   R IC A  V M
         nan-Amel  (539)  E  FLGLN  F  EN  T A  RVM  SCC    -T   RL  A   M
         nan-Mrot  (618)  E  F GLN  F EN  T    RVMF SCC  M-S    LS A  V M
         nan-Nvit  (534)  E  FLGLN  F  EN  T A  RVMF SCC   -S   RMSCA  V
         nan-Apis  (494)  E GFLGTQ  F  EN AI A  RVMF SCCLMM-TI PLRLTCY KA  I
  nan-Mper partial (554)  E G  SQ  F  EN AI A  RVMF  CLMM-TI PLRLTCY KA
  nan-Nlug partial (443)  E  FLGLK    EN  T A  RVMF SCC  M-TM   FTCQ    I
         nan-Bmor  (552)     L  IK  F   S    RVMF  CL  L-IL T R W A    H
  nan-Btab_partial (522) XXXXXXXXXXXXXXXXXXXXXXXXXXXXXXXXX-XXXXXXXXXXXXXXXX
         nan-Dple  (356) --------------------------------------------------
  nan-Eher partial (451)     LGWS  F  EN  T A  RVM  SCC  M -TM    TN     M
         nan-Phum  (524)     L IH  F  EN  T A  RV   G CC  Q-FV W  T K   I
  nan-Same partial (163) --------------------------------------------------
         nan-Dpon  (476) -------------   A   RVMF  SC  N GV  S  V M  V
         nan-Tcas  (516)    F GR  F EN  T A  RVMF SC  M -T  C R A    D
```

FIGURE 112 - CONTINUATION

```
                          701                                               750
        nan-Aaeg   (581)  AVFIMLTTAPYFLPPCRGPKTVGPFVVMIYRMVMGDLLRFVVIYLVFVMG
        nan-Cqui   (582)  AVVIMLTTAPYFLPPCRGPKTVGPFVVMIYRMVMGDLLRFVATYSVFVMG
        nan-Adar   (574)  ---------------KGPKTVGPFVVMLYRMVMGDLLRFVVIYLVFVPC
        nan-Agam   (599)  AVFIMLTTAPYLLPPCRGPKTVGPFVVMLYRMVMGDLLRFVVIYLVFVMG
        nan-Ccap   (594)  AVFIMLTTAPYFLPPCRGPKTVGPFVVMLYRMVMGDLLRFVSIYLVFVMG
        nan-Mdom   (588)  AVMIMLTTAPYFLPPCRGPKTVGPFVVMIYRMVMGDLLRFVSIYLVFVMG
        nan-Dmel   (584)  TVVIMLTTAPYFLPPCKGPKTVGPFVVMLYRMVMGDLLRFVSIYLVFVMG
        nan-Aech   (665)  AVVVMLTTAPYFLPPCRGPKTVGPFVVMIYRMIMGDLLRFVSIYLVFVMG
        nan-Sinv   (632)  AVVVMLTTAPYFLPPCRGPKTVGPFVVMIYRMIMGDLLRFVCIYLVFVMG
        nan-Cflo   (666)  AVVVMLTTAPYFLPPCRGPKTVGPFVVMIYRMTGDLLRFVSIYLVFVMG
        nan-Hsal   (667)  AVVVMLTTAPYFLPPCRGPKTVGPFVVMIYRMIMGDLLRFVSIYLVFVMG
        nan-Aflo   (677)  AVVVMLTTAPYFLPPCRGPKTVGPFVVMIYRMIMGDLLRFVSIYLVFVMG
        nan-Amel   (588)  AVVVMLTTAPYFLPPCRGPKTVGPFVVMIYRMIMGDLLRFVSIYLVFVMG
        nan-Mrot   (667)  AVVVMLTTAPYFLPPCRGPKTVGPFVVMIYRMIMGDLLRFVSIYLVFVMG
        nan-Nvit   (583)  AVVVMLTTAPYFLPPCRGPKTVGPFVVMIYRMIMGDLLRFVSIYNVFVMG
        nan-Apis   (543)  AVFIMLTTCPYFLPPCRGPKTVGPFVVMIYRMVMGELLRFVSIYNVFVMG
nan-Mper partial   (603)  AVFIMLTTCPYFLPPCRGXXXXXXXXXMIYRMVMGDLLRFVSIYNVFVMG
nan-Nlug partial   (492)  AVVIMLTTGPYFLPPCRGPKTVGPFVVMIYRMVMGDLLRFVSIYNVFVMG
        nan-Bmor   (601)  AVMIMLTTAPYFLPPCRGPKTVGPFVVMIYRMVMGDLLRFVCIYLVFVMG
nan-Btab_partial   (571)  XXXIMLLTSPYFLPPCRGPKTVGPFVVMIYRMVMGDLLRFVSINVFVMG
        nan-Dple   (356)  --------------------------------------------------
nan-Eher partial   (500)  AVFIMLTTAPYFLPPCRGPKTVGPFVVMLYRMIMGDLLRAVSIYLVFVMG
        nan-Phum   (573)  AVFIMLTTAPYFLPPCRKMNDP------WRLFFFLIKMIFFIIFFFFFFF
nan-Same partial   (163)  --------------------------------------------------
        nan-Dpon   (510)  AVVVMLTTAPYFLPPCRGPKTVGPFVVMIYRMIGDLLRAVIYLVFVTMG
        nan-Tcas   (565)  AVVIMLTTAPYFLPPCRGPKTVGPFVVMIYRMVMGDLLRRASIYLVFVMG 751                                               800
        nan-Aaeg   (631)  FSQAYYIVFLSFKGE------SKGDENPMPSPMESIVAMFLMSFTNFGDY
        nan-Cqui   (632)  FSQAYYIAFLSYKGE------SKGDENPMPSPMESIVAMFLMSDTNFGDY
        nan-Adar   (608)  FSQAYYIVFLSYKPE------SKGDANEMPSPIESIVAMFLMSFTNFGDY
        nan-Agam   (649)  FSQAYYIVFLSYKPD------SKGDPNPMPSPIESIVAMFLMSFTNFGDY
        nan-Ccap   (644)  FSQAYYIIFLTFDKPATPEESDSESNPMPSPMESIVAMFLMSFTNFGDY
        nan-Mdom   (638)  FSQAYYIIFLTFDKPATPETDDGTNPMPSPMESVVAMFLMSFTNFGDY
        nan-Dmel   (634)  FSQAPYIIFLTFDKPSSPEDQDAE-SNPMPSPMESIVAMFLMSFTNFGDY
        nan-Aech   (715)  FSQAYYIIFLSFDKNTPEGIDDSITNPMPSPMESVVAMFLMSFTNFGDY
        nan-Sinv   (682)  FSQAYYIIFLSFDKNTPEGIDDSITNPMPSPMESVVAMFLMSFTNFGDY
        nan-Cflo   (716)  FSQAYYIIFLSFDKNTPEGVDDSITNPMPSPMESVVAMFLMSFTNFGDY
        nan-Hsal   (717)  FSQAYYIIFLSFDKNTPEGVDDSVSNPMPSPMESIVAMFLMSMTNFGDY
        nan-Aflo   (727)  FSQAYYIIFLSFDKNTPEGVDDMSNPMPSPIESIVAMFLMSMTNFGDY
        nan-Amel   (638)  FSQAYYIIFLSFDKNTPEGVDDMSNPMPSPIESIVAMFLMSMINFGDY
        nan-Mrot   (717)  FSQAYYIIFLSFDKNTPEGVDDSVSNPMPSPIESIVAMFLMSMTNFGDY
        nan-Nvit   (633)  FSQAYYIIFLSFDKRITPEGVDDSKANPLPSAMESIVAMFLMSFINFGDY
        nan-Apis   (593)  FSQAYYVIFLSYDKPLTPEGIDDSVLNPMPRPTESIVAMFLMSWNTETIY
nan-Mper partial   (653)  FSQAYYVIFLSYDKPLTPEGIDDSVLNPMPRPTESIVAMFLMSWNTETIY
nan-Nlug partial   (542)  FSQAYYIIFLSYDKPTTPEGIDDTSNPLSFIEAIMAMFFTSFINFGDY
        nan-Bmor   (651)  FSQAYYVIFLSFDKNTPEGVDDSVSNPMPSPIESIMAMFLMSFSFDY
nan-Btab_partial   (621)  FSQAYYIIFLSFDKESTPDGVLEIVSNPMPNPVEAGMAMFLMSFNTFGDY
        nan-Dple   (356)  --------------------------------------------------
nan-Eher partial   (550)  ASAYYIIFLSFDKSLTPEGVDDSVSNPIPNMEAVMAMFFSMTSFGDY
        nan-Phum   (617)  TKPTYIIFLSFDKPKITPDVLDSGTNPMQSFVESIMAMFLMSINKGDY
nan-Same partial   (163)  --------------------------------------------------
        nan-Dpon   (560)  FSQAYYIIFLSFDKPLTPDDVDSATNPKSTPIESIMAMFLMSMINFGDY
        nan-Tcas   (615)  FSQARYIIFLSFDKPLTPDVDSATNPKSTPIESIMAMFLMSNTFGDY
```

FIGURE 112 - CONTINUATION

Sequence alignment, positions 801-900, showing nan protein sequences from multiple species (nan-Aaeg, nan-Cqui, nan-Adar, nan-Agam, nan-Ccap, nan-Mdom, nan-Dmel, nan-Aech, nan-Sinv, nan-Cflo, nan-Hsal, nan-Aflo, nan-Amel, nan-Mrot, nan-Nvit, nan-Apis, nan-Mper partial, nan-Nlug partial, nan-Bmor, nan-Btab partial, nan-Dple, nan-Eher partial, nan-Phum, nan-Same partial, nan-Dpon, nan-Tcas).

FIGURE 112 - CONTINUATION

```
                         901                                              950
       nan-Aaeg    (775) ...........VERELRAEQRRLIME------KYANVP---
       nan-Cqui    (776) ...........AVEREARAEQRRLIAE------KYANVP---
       nan-Adar    (752) ...........VERDARAEQRRLLRE------KYLNMT---
       nan-Agam    (792) ...........IERDARAEQRRLLRE------KYLNMSS--
       nan-Ccap    (794) ...........IEREARAQKRQEEYE------KFFGKKP-S
       nan-Mdom    (788) ...........MEREARAKKRQEEYE------KFFGATP-T
       nan-Dmel    (782) ...........MEREARALRRQQEYE------KFFGTAPKS
       nan-Aech    (823) ...........MSKEKIIFETEPI------ITKN-----
       nan-Sinv    (832) ...........MSKEKILS--------------------
       nan-Cflo    (866) ...........ILKEKALAETEAV------ITRK-----
       nan-Hsal    (867) ...........MSKEKVLAESEII------ITRN-----
       nan-Aflo    (877) ..........-IMKKILTSEDNV------IL-------
       nan-Amel    (788) ..........-TMKKILTSEDNV------IL-------
       nan-Mrot    (867) ...........TTKEKTTITEENV------TL-------
       nan-Nvit    (783) ...........LQKAKEDAEKLQQ------QMADKDNKD
       nan-Apis    (743) ...........DLSSKLSSSCGKNANNGTFNLKANE---
nan-Mper partial    (803) ...........DLSSKLSSSCGKNANDGTINLKANK---
nan-Nlug partial    (692) ..........-KGLKLLGTTTPSPK------RMKGRETPI
       nan-Bmor    (801) ...........EALKPGEIPPPAR------DYPIRK---
nan-Btab_partial    (771) ...........LAKLSNNASPSNKPLVDLPNLSNHDSPT
       nan-Dple    (356) ---------------------------------------
nan-Eher partial    (700) ..........-KEREKSMNKS----------PNLINLNSPA
       nan-Phum    (767) ...........KAKENKNVTFAGTPKN------GIKNRLLGP
nan-Same partial    (163) ---------------------------------------
       nan-Dpon    (708) ---------------------------------------
       nan-Tcas    (765) ...........EKLKENAKKN------------------

951        964
       nan-Aaeg    (816) --------------    (SEQ ID NO: 59)
       nan-Cqui    (817) --------------    (SEQ ID NO: 60)
       nan-Adar    (793) --------------    (SEQ ID NO: 63)
       nan-Agam    (834) --------------    (SEQ ID NO: 58)
       nan-Ccap    (837) GNSDNNNA------    (SEQ ID NO: 57)
       nan-Mdom    (831) SDNENNNF------    (SEQ ID NO: 56)
       nan-Dmel    (826) ECSDNNNF------    (SEQ ID NO: 54)
       nan-Aech    (862) --------------    (SEQ ID NO: 74)
       nan-Sinv    (862) --------------    (SEQ ID NO: 73)
       nan-Cflo    (905) --------------    (SEQ ID NO: 75)
       nan-Hsal    (906) --------------    (SEQ ID NO: 66)
       nan-Aflo    (913) --------------    (SEQ ID NO: 70)
       nan-Amel    (824) --------------    (SEQ ID NO: 110)
       nan-Mrot    (904) --------------    (SEQ ID NO: 68)
       nan-Nvit    (827) KAVIIQ--------    (SEQ ID NO: 111)
       nan-Apis    (790) --------------    (Residues 1-448 & 560-900 of SEQ ID NO: 64)
nan-Mper partial    (850) --------------    (SEQ ID NO: 76)
nan-Nlug partial    (735) --------------    (SEQ ID NO: 79)
       nan-Bmor    (842) --------------    (SEQ ID NO: 62)
nan-Btab_partial    (821) KPLLDLASNLSKF-    (SEQ ID NO: 77)
       nan-Dple    (356) --------------    (SEQ ID NO: 72)
nan-Eher partial    (739) ENVKNTNPFS----    (SEQ ID NO: 78)
       nan-Phum    (811) VPPLKSIPSKPKI-    (SEQ ID NO: 71)
nan-Same partial    (163) --------------    (SEQ ID NO: 80)
       nan-Dpon    (708) --------------    (SEQ ID NO: 65)
       nan-Tcas    (795) --------------    (SEQ ID NO: 61)
```

```
FIGURE 113
                              1                                                  50
          iav-Aaeg      (1)   MVQFDWRRMCRKKRKVPQQGALLDQVLSCSANASNQCLLYKMANYKRGGI
          iav-Cqui      (1)   MVKFDWRRMCRKKKNVPQQGALLDQVLSCSTNVQGQCLLYKMANYKGCGI
          iav-Agam      (1)   MVHLDPLRLCRKKRKLPQQGALLDQVLSCSASASNCCLLYKMANYKRCCI
          iav-Ccap      (1)   -MKFFLKKCLRKKPEENKPGALLDAVLSCSSPMANKCLLYKLADYMRCGD
          iav-Mdom      (1)   -MRLFMKKCLRKKPQELFPGALLDAVLSCSSATASKCLLYKLADYKRGGD
          iav-Dmel      (1)   -MKFLLKKCLRKKAPENKPGALLDAVLSCSSATACKCLLYKLADYKRGGI
          iav-Apis      (1)   -MGNSCASSTDFSFSKTASGSVLDRVLSCAS-NEDCCLLYKLADYKKGGE
   iav-Mper partial     (1)   --------------------------------------------------
          iav-Bmor      (1)   MGNAIGKFLTAG--NVQGAGSVLLRVLSCPS-SEDHTVLYKLADYENGGL
          iav-Dple      (1)   MGVPLSKLCSAT--CVPAVGSVLDRVLSCPS-SEDHTVLYKLADYKKGCL
          iav-Aech      (1)   --MGGVCSCRVGRNSQVNAGSLLDRVLSCAS-NEDCCLLYRLADYKKGCE
          iav-Cflo      (1)   --MGGVCSCRVGRGNQLNAGSILDRVLSCAS-NEDCCLLYRLADYKKGCE
          iav-Hsal      (1)   --MGGVCSCRG-RGSQVNAGSILDRVLSCAS-NEDCCLLYRLADYKKGGE
          iav-Aflo      (1)   --MGGVCSFRG-RGSQVNSGSILDRVLSCAS-DEDCCLLYRLADYKKGGE
          iav-Amel      (1)   --MGGVCSFRG-RGSQVNAGSILDRVLSCAS-DEDCCLLYRLADYKKGGE
          iav-Bimp      (1)   --MGGVCSCRG-RGSQVNAGSILDRVLSCAS-DEDCCLLYRLADYKKGGE
          iav-Bter      (1)   --MGGVCSCRG-RGSQVNAGSILDRVLSCAS-DEDCCLLYRLADYKKGGE
          iav-Mrot      (1)   --MGGVCSCRG-LGSQVNAGSILDRVLSCAS-DEDCCLLYRLADYKKSGE
          iav-Sinv      (1)   --MGGACSCRFGRGSQVNPGSLLDRVLSCAS-NEDCCLLYRLADYKKGCE
          iav-Nvit      (1)   --MGGACSCQG-RDSQVNAGSILDRVLSCAS-DEDCCLLYRLADYKKGGE
   iav-Same partial     (1)   --------------------------------------------------
          iav-Btab      (1)   --------------------------------------------------
          iav-Eher      (1)   -----MGIIWGSGASSVNACTVLDRVLSCAS-NKDCCLLYRLADYKKGGE
          iav-Dpon      (1)   MGGCQCKPCCKHKKSHYTGCSILDRVLSCSS-NQDCCLLYRLADYKKGGE
          iav-Tcas      (1)   MGAKVCKPCKKRKANTSQCGSILDRVLSCAS-NQDCCLLYKLADYKKGGE
          iav-Phum      (1)   ----MGAGLCGTSQDPQNQGSVLDRVLSCAS-NKDCCLLYRLADYKNSGE 51                                                 100
          iav-Aaeg     (51)   LIDARQVSSQKAVEQLIREQFCVFMYNNGRCCTINRAEYLRWKYMDNHEV
          iav-Cqui     (51)   LIDAFMGSQKAVEQLIREQFCVFMYNAGRGGTINRAEYLRWKYMDNHEV
          iav-Agam     (51)   LIDARQISGKAVEQLIREQFCVFMYNKGRGGTINRAEYLRWKYMDNHEV
          iav-Ccap     (50)   LIDALTGGLVAVEQLIREQFCVFMYNDGKGQVINRAEFLRWKYRDHTEV
          iav-Mdom     (50)   LIDAINTGSLVAVEQLIREQFCVFMYNDGKGQVINRAEFLRWKYRDHTEV
          iav-Dmel     (50)   LIDRINSGGLIAVEQLIREQFCVFMYNDGKGQVINRAEFLRWKYRDHTEV
          iav-Apis     (49)   LINVYKNGCQDEAERFIVEKLPGLMYNNGKGQVMRNDYLRWKEQNRKHY
   iav-Mper partial     (1)   --------------------------------------------------
          iav-Bmor     (48)   LDETYAKGGMTAAEKLMRDEFAAYMYGGCRGRVINRAEYLRWKFRDQFQV
          iav-Dple     (48)   LDETYTKGGVVAAERLIEEFSAYMYAGCRGRVINRAEYLRWKFRDQEQV
          iav-Aech     (48)   LIDAYNQGGQPEVEKLIREQFCVLMYMDGKGQIINRAEYLRWKFRDLEQV
          iav-Cflo     (48)   LIDAYNQGGQPEVEKLVREQFCVLLMYADGKGQVINRAEYLRWKFRDLEQV
          iav-Hsal     (47)   LIDAYNQGGQPEVEKLIREQFCVLMYADGKGQVINRAEYLRWKFRDLEQV
          iav-Aflo     (47)   LIBSYNQGGQFEVEKLIREQFCVLMYANGKGQVINRAEYLRWKFRDLEQV
          iav-Amel     (47)   LIBSYNQGGQFEVEKLIREQFCVLMYADGKGQVINRAEYLRWKFRDLEQV
          iav-Bimp     (47)   LIBSYNQGGQAEVEKLIREQFCVLMYADSKGQAINRAEYLRWKFRDLEQV
          iav-Bter     (47)   LIBSYNQGGQAEVEKLIREQFCVLMYADGKGQAINRAEYLRWKFRDLEQV
          iav-Mrot     (47)   LIDAYNQGGQAEVEKLIREQFCVLMYADGKGQMINRAEYLRWKFRDLEQV
          iav-Sinv     (48)   LIDAYNQGGQPEVEKLIREQFCVLMYADGKGQTINRAEYLRWKFRDLEQV
          iav-Nvit     (47)   LIDAYNQGGQAEVEKLIREQFCVLMYADGKGQTINRAEYLRWKFRDLEQV
   iav-Same partial     (1)   -----------------------MYNDGCQILKRAEYLRWKFRDQCQV
          iav-Btab      (1)   -----------------------MYNDGCQILKRAEYLRWKFRDQCQV
          iav-Eher     (45)   LIDAYNAGGGSEVEKLIREQFSQLMYNEGKGALINRAEYLRWKFRDMCQV
          iav-Dpon     (50)   LIDAYNAGCQIEGKLIRDQFAQLMYQDGKGMIINRSEYLRWKFRDHERV
          iav-Tcas     (50)   LIDAYNQGGQAEVEKLIREQFCQLMYQEGKGGTINRSEYLRWKFRDHEQV
          iav-Phum     (46)   LIDAYNIGCQAEVEKLIKEQFCVLMYADGKGEVIKRAEYLRWKFRDQACV
```

FIGURE 113 - CONTINUATION

```
                          101                                              150
        iav-Aaeg   (101)  VLPIEASLSPHDPLGKWVDHKACWQKQYRGLLGESLLHVLIICDTKIHTR
        iav-Cqui   (101)  VLPIEASLSPHDPLGKWVDHKACWQKQYRGLLGESLLHVLIICDTKIHTR
        iav-Agam   (101)  ILPIEASLSPHDPLSKWDDHKACWQKQYRGLLGESLLHVLIICDTKVHTR
        iav-Ccap   (100)  TLPIEASLSRHDPLGKWEDHKACWQKQRGALGESLLHVLIICDSKIHTR
        iav-Mdom   (100)  TLPIEASLSIHDPLGKWKDHSACWQKQYRGALGESLLHVLIICDSKMHTR
        iav-Dmel   (100)  TLPIEASLSIHDPLGWEDHKACWQMQYRGALGESLLHVLIICDSKVHTR
        iav-Apis    (99)  AVNVEERPGPHDPLTRWVDHVACWQKQYRGSLGESLLHVLIICDTVIHTR
 iav-Mper partial    (1)  -----ERPGPHDPLTRWVDHVACWQKQYRGSLGESLLHVLIICDTVIHTR
        iav-Bmor    (98)  VLPIEASLSPYDPLAKWEDHTACWQKCYRGALGESLLHVLIICDTEIHTH
        iav-Dple    (98)  VLPIEASLSPHDPLAKWEDHTACWQKSYRGALGESLLHVLIICDTKIHTR
        iav-Aech    (98)  VLPIEASLSRFDPLAQWNDHEACWQKQYRGSLGETLLHVLIICDTRMHTR
        iav-Cflo    (98)  VLPIEASLSRFDPLAQWNDHEACWQKQYRGSLGEALLHVLIICDTRIHTR
        iav-Hsal    (97)  VLPIEASLSRFDPLAQWYDHEACWQKQYRGSLGESLLHVLIICDTRMHTH
        iav-Aflo    (97)  VLPIEASLSQFDPLAQWNDHEACWQKQYRGSLGETLLHVLIICDTRIHTR
        iav-Amel    (97)  VLPIEASLSQFDPLAQWNDHEACWQKQYRGSLGETLLHVLIICDTRIHTR
        iav-Bimp    (97)  VLPIEASLSQFDPLAQWNDHEACWQKQYRGSLGETLLHVLIICDTRIHTR
        iav-Bter    (97)  VLPIEASLSQFDPLAQWNDHEACWQKQYRGSLGETLLHVLIICDTRIHTH
        iav-Mrot    (97)  VLPIEASLSRFDPLAQWNDHQACWQKQYRGSLGETLLHVLIICDTRIHTR
        iav-Sinv    (98)  VLPIEASLTRFDPLAQWNDHEACWQKQYRGSLGETLLHVLIICDTRMHTR
        iav-Nvit    (97)  VLPIEASLSRFDPLAQWSDHEACWQKQYRGSLGETLLHVLIICDTRTHTR
 iav-Same partial    (1)  --------------------------------------------------
        iav-Btab    (27)  TLPIEASLSPHDPLAKWEDHEACWQKQYRGSLGETLLHVLIICDTKTNTR
        iav-Eher    (95)  QLPIEASLSSQDPLSKWEDHQCWQKQYRGSLGETLLHVLIICDTKIHTR
        iav-Dpon   (100)  VLPIEASLSRYDPLGKWTDHEACWQKQYRGSLGESLLHVLIICDSKIHTR
        iav-Tcas   (100)  VLPIEASLSRYDPLAKWNDHEACWQKQFRGSLGESLLHVLIICDTKIHTR
        iav-Phum    (96)  VLPIEASLSIYDPLAKWEDHEACWQKQYRGSLGETLLHVLIICDSKIHTR 151                                              200
        iav-Aaeg   (151)  VARILLRVFELSIDVMEGEEYLGASALLAIAYSNNELVGELIDAGADV
        iav-Cqui   (151)  VSRILLRVFELSIDVMEGEEYLGASALLAIAYSNNELVGELIDAGANV
        iav-Agam   (151)  IARILLRVFPEQSIDVMEGEEYLGASALLAIAYSNNELVGELIDAGADV
        iav-Ccap   (150)  IARVILRVFPNLAQDVMEGEEYLGASALLAIAYSNNEVAELIEAGADI
        iav-Mdom   (150)  LARILLRVFPRLASDVIEGEEYLGASALLAIAYSNNEIVAELIEAGADI
        iav-Dmel   (150)  ARVILRVFPNLASDVMEGEEYLGASALLSIAYSNNEVAELIEAGADI
        iav-Apis   (149)  LSRILLKHYPMLSQDVVEGEEYLGASALLSIAYNNDLSQELVDAGANI
 iav-Mper partial   (46)  LSRILLKHYPMLSQDVVEGEEYLGASALLSIAYNNDLSQELVDAGANI
        iav-Bmor   (148)  LARTLVKCFPKLSSDVVEGEEYLGASSLELAIAYSNNELVQELVEAGADV
        iav-Dple   (148)  LARTIVKCFPKLSSDVVEGEEYLGASSLELAIAYGNNELVQELVEAGADV
        iav-Aech   (148)  LARILLKCFPRLAIDVVEGEEYLGASALLAIAYANNELVQELVEAGAII
        iav-Cflo   (148)  LARTLLKCFPRLAIDVVEGEEYLGASALLAIAYNNNELVQELVDAGAII
        iav-Hsal   (147)  LARTLLKCFPRLAIDVVEGEEYLGASALLAIAYNNNELVQELVEAGAII
        iav-Aflo   (147)  MARTLLKCFPRLAIDVVEGEEYLGASALLAIAYNNNELVQELVEAGAII
        iav-Amel   (147)  MARTLLKCFPRLAIDVVEGEEYLGASALLAIAYNNNELVQELVEAGAII
        iav-Bimp   (147)  LARTLLKCFPRLAIDVVEGEEYLGASALLAIAYNNNELVQELVEAGAII
        iav-Bter   (147)  LARTLLKCFPRLAIDVVEGEEYLGASALLAIAYNNNELVQELVEAGAII
        iav-Mrot   (147)  LARTLLKCFPRLAIDVVEGEEYLGASALLAIAYNNNELVQELVEVGAII
        iav-Sinv   (148)  LARTLLKCFPRLSIDVVEGEEYLGASALLAIAYNNNELVQELVEAGAII
        iav-Nvit   (147)  LARTLLKCFPRLAIDVVEGEEYLGASALLAIAYANNELVQELVEAGAIV
 iav-Same partial   (1)   --------------------------------------------------
        iav-Btab   (77)   LARTLLKCFPRLAQDIVEGEEYLGASALELAIAYNNNELVQELVEAGANV
        iav-Eher  (145)   LARTLLKCFPRLAIDVVEGEEYLGASALELAIAYFNNELVQELVEAGANV
        iav-Dpon  (150)   LARTLIKCFPKLASDVVEGEEYLGASALLLAIAYSNNELVQELVEAGANV
        iav-Tcas  (150)   LARTLIKCFPKLASDVVEGEEYLGASALLLAIAYNNNELVQELVEAGANV
        iav-Phum  (146)   LARTLLKCFPKLASDIVEGEEYLGASALLLAIAYNNNELVQELVDAGANV
```

FIGURE 113 - CONTINUATION

```
                         201                                                    250
       iav-Aaeg   (201)  SQRAIG---------------RFFLPRDQQ-GLKPAKNTDYEGLAYLGEY
       iav-Cqui   (201)  SQRAIG---------------RFFLPRDQQ-KMHPAKTTDYEGLAYLGEY
       iav-Agam   (201)  SQRATG---------------RFFLPRDQQ-GLRPAKTTDYEGLAYLGEY
       iav-Ccap   (200)  NQRAIG---------------SFFLPRDQQ-KRNPAKSTDYEGLAYLGEY
       iav-Mdom   (200)  NQRAIG---------------SFFLPRDQQ-KANPAKSTDYEGLAYMGEY
       iav-Dmel   (200)  HQRAIG---------------SFFLPRDQQ-KANPAKSTDYEGLAYMGEY
       iav-Apis   (199)  CQRAIG---------------SFFLPRDQQNKEINNKHTDYEGLAYLGEL
  iav-Mper partial  (96) CQRAIG---------------SFFLPRDQQNKEINNKHTDYEGLAYLGEL
       iav-Bmor   (198)  NQRAIG---------------SFFLPRDQQ-RVPPARQTNYEGLAYLGEY
       iav-Dple   (198)  SQRAIG---------------SFFLPRDQQ-KNPPARQTNYEGLAYLGEY
       iav-Aech   (198)  SQRAIG---------------SFFLPRDQQ-KMNPAKNTDYEGLAYLGEY
       iav-Cflo   (198)  SQRAIG---------------SFFLPRDQQ-GMNPVRNTDYEGLAYLGEY
       iav-Hsal   (197)  SQRAIG---------------SFFLPRDQQ-KMNPVRNTDYEGLAYLGEY
       iav-Aflo   (197)  SQRAIG---------------SFFLPRDQQ-KMNPAKNTDYEGLAYLGEY
       iav-Amel   (197)  SQRAIG---------------SFFLPRDQQ-KTNPAKNTDYEGLAYLGEY
       iav-Bimp   (197)  SQRAIG---------------SFFLPRDQQ-KTNPAKNTDYEGLAYLGEY
       iav-Bter   (197)  SQRAIG---------------SFFLPRDQQ-KTNPAKNTDYEGLAYLGEY
       iav-Mrot   (197)  SQRAIG---------------SFFLPRDQQ-KMNPAKNTDYEGLAYLGEY
       iav-Sinv   (198)  SQRAIG---------------SFFLPRDQQ-KMNPARNTDYEGLAYLGEY
       iav-Nvit   (197)  SQRAIG---------------SFFLPRDQQ-KPRPAKSTDYEGLAYLGEY
  iav-Same partial   (1) --------------------------------------------------
       iav-Btab   (127)  NQRAIG---------------SFFLPKQQ-KPRPAKHTDYEGLAYLGEY
       iav-Eher   (195)  EQRAIG---------------SFFLPRDQQ-GQRPSKHTDYEGLAYLGEY
       iav-Dpon   (200)  NQRAIGKQIADKTGKINAKNRSFFLPRDQQ-KQRPAKHTDYEGLAYLGEY
       iav-Tcas   (200)  NQRAIG---------------SFFLPRDQQ-RQKPAKHTDYEGLAYLGEY
       iav-Phum   (196)  NQRAVG---------------SFFLPKQQ-KAKPLKTTDYEGLAYLGEY 251                                                    300
       iav-Aaeg   (235)  PLAWAACCAKESVYNLLLECGADPNAQDSFGNMILHCVVVCDKLDMFGYA
       iav-Cqui   (235)  PLAWAACCSKESVYNLLLECGADPNAQDSFGNMILHCVVVCDKLDMFGYA
       iav-Agam   (235)  PLAWAACCAKESVYNLLLECGADPNAQDSFGNMILHCVVVCDKLDMFGYA
       iav-Ccap   (234)  PLAWAACCAKESVYNLLVCGADPDAQDSFGNMILHCVVVCDKLDMFGYA
       iav-Mdom   (234)  PLSWAACCAKESVYNLLIDHDADPDAQDSFGNMILHCVVVCDKLDMFGYA
       iav-Dmel   (234)  PLAWAACCAKESVYNLLVCGADPDAQDSFGNMILHCVVVCDKLDMFGYA
       iav-Apis   (234)  PLAWAACCGKPVYNLLIDAGANPDAQDSFGNMILHCVVVCDKLSMFGYA
  iav-Mper partial (131) PLAWAACCGKPVYNLLIDAGANPDAQDSFGNMILHCVVVCDKLSMFGYA
       iav-Bmor   (232)  PLAWTACCAKEAVYNLLIDSGADPDAQDSFGNMILHCVVVCDKLDMFGYA
       iav-Dple   (232)  PLAWAACCAKEVVYNLLIDSGADPDAQDSFGNMILHCVVVCDKLDMFGYA
       iav-Aech   (232)  PLAWAACCAKESVYNLLIDSGADPDEQDTPGNMILHCVVVCDKLDMFGYA
       iav-Cflo   (232)  PLAWAACCAKESVYNLLIDSGADPDEQDSFGNMILHCVVVGDKLDMFGYA
       iav-Hsal   (231)  PLAWAACCAKESVYNLLIDSGADPDEQDSFGNMILHCVVVCDKLDMFGYA
       iav-Aflo   (231)  PLAWAACCAKESVYNLLIDSGADPDEQDSFGNMILHCVVVCDKLDMFGYA
       iav-Amel   (231)  PLAWAACCAKESVYNLLIDSGADPDEQDSFGNMILHCVVVCDKLDMFGYA
       iav-Bimp   (231)  PLAWAACCAKESVYNLLIDSGADPDEQDSFGNMILHCVVVCDKLDMFGYA
       iav-Bter   (231)  PLAWAACCAKESVYNLLIDSGADPDEQDSFGNMILHCVVVCDKLDMFGYA
       iav-Mrot   (231)  PLAWAACCAKESVYNLLIDSGADPDEQDSFGNMILHCVVVCDKLDMFGYA
       iav-Sinv   (232)  PLAWAACCAKESVYNLLIDSGADPDEQDSFGNMILHCVVVGDKL------
       iav-Nvit   (231)  PLAWAACCAKESVYNLLIDSGAHPDEQDTPGNSILHCVVVCDKLVRFGYA
  iav-Same partial   (1) --------------------------------------------------
       iav-Btab   (161)  PLSWAACCAKESVYNLLIDSGAHPDMQDTPGNMILHCVVVCDKLDMFGYA
       iav-Eher   (229)  PLAWAACCAKESVYNLLIDNGANPDHFDTPGNMILHCVVVCDKLDMFGYA
       iav-Dpon   (249)  PLAWAACCAKESVYNLLIDSGAHPDLQDNPGNMILHCVVVCDKLDMFGYA
       iav-Tcas   (234)  PLAWAACCAKESVYNLLIDSGAHPDYQDNFGNMILHCVVVCDKLDMFGYA
       iav-Phum   (230)  PLSWAACCSKESVYNLLIDVGADPDSQDSPGNMILHCVVVCDKLDMFGYA
```

FIGURE 113 - CONTINUATION

```
                         301                                                350
       iav-Aaeg   (285)  LRHPKIPCKNGIVNESGLTPLTLACKLGRDEVEREMLELSAREFWRYSN
       iav-Cqui   (285)  LRHPKIPCKNGIVNEAGLTPLTLACRLGRDEVEREMLELSAREFWRYSN
       iav-Agam   (285)  LRHPKIPCKNGIVNAAGLTPLTLACRLGRDEVEREMLELSAREFWRYSN
       iav-Ccap   (284)  LRHPKTPAKNGIANHSGLTPLTLACKLGRAEVEREMLELSAREFWRYSN
       iav-Mdom   (284)  LRHPKTPAKNGIVNHSGLTPLTLACKLGRAEVEREMLELSAREFWRYSN
       iav-Dmel   (284)  LRHPKTPAKNGIVNQTGLTPLTLACKLGRAEVEREMLELSAREFWRYSN
       iav-Apis   (284)  LKHPKVKASNGIMNVAGLTPLTLSCKLARTSVEREMLELSAREFWRYSN
  iav-Mper partial (181) LKHPKVFASNGIMNVAGLTPLTLSCKLARTSVEREMLELSAREFWRYSN
       iav-Bmor   (282)  LRHPKVPASNGRMNKAGFTPLTLACQLGRASVEREMLELSAREFWRYSN
       iav-Dple   (282)  LRHPKVPASNGRLNKAGFTPLTLACQLGRASVEREMLELSSREFWRYSN
       iav-Aech   (282)  LRHPKIPARNGIVNAAGLTPLTLACQLGRAEVEREMLELSAREFWRYSN
       iav-Cflo   (282)  LRHPKLPARNGIANAAGLTPLTLACQLGRAEVEREMLELSAREFWRYSN
       iav-Hsal   (281)  LRHPKIPTRNGIVNAAGLTPLTLACQLGRAEVEREMLELSAREFWRYSN
       iav-Aflo   (281)  LRHPKIPARNGIVNAAGLTPLTLACQLGRAEVEREMLELSAREFWRYSN
       iav-Amel   (281)  LRHPKIPARNGIVNAAGLTPLTLACQLGRAEVEREMLELSAREFWRYSN
       iav-Bimp   (281)  LRHPKIPARNGIVNAAGLTPLTLACQLGRAEVEREMLELSAREFWRYSN
       iav-Bter   (281)  LRHPKIPARNGIVNAAGLTPLTLACQLGRAEVEREMLELSAREFWRYSN
       iav-Mrot   (281)  LRHPKIPARNGIVNAAGLTPLTLACQLGRAEVEREMLELSAREFWRYSN
       iav-Sinv   (276)  -------------------------------------------------
       iav-Nvit   (281)  LRHPKLPASNGIANAAGLTPLTLACLGRAEVEREMLELSAREFWRYSN
  iav-Same partial  (1)  -------------------------------------------------
       iav-Btab   (211)  LRHPKLPASNGIINTAGLTPLTLACKLGRAEVEREMLELSAREFWRYSN
       iav-Eher   (279)  LRHPKMPASNGIANVAGLTPLTLACKLGRAKVEREMLELSAREFWRYSN
       iav-Dpon   (299)  LRHPKLPASNGIINKAGLTPLTLACKLGRAEVEREMLELSAKEFWRYSN
       iav-Tcas   (284)  LRHPKIPASNGIVNKAGLTPLTLACKLGRAEVEREMLELSAKEFWRYSN
       iav-Phum   (280)  LRHPKVPASNGIINNEGLTPLTLACKLGRADVEREMLELSAKEFWRYSN 351                                                400
       iav-Aaeg   (335)  TCSGYPLNALDTLMFDGTTNWNSALFTILNGTKEEHLMEDGGIVERLLE
       iav-Cqui   (335)  TCSGYPLNALDTLMFDGSTNWNSALFTILNGTKEEHLMEDGGIVERLLE
       iav-Agam   (335)  TCSGYPLNALDTLMFDGSTNWNSALFTILNGTKEEHLMEDGGIVERLLE
       iav-Ccap   (334)  TCSGYPLNALDTLLFDGRTNWNSALFTILNGTKEEHLDMDGGIIQRLLE
       iav-Mdom   (334)  TCSGYPLNALDTLLFDGRTNWNSALFTILNGTKEEHLDMDGGIIQRLLE
       iav-Dmel   (334)  TCSGYPLNALDTLLFDGRTNWNSALFTILNGTKPEHLDMDGGIIQRLLE
       iav-Apis   (334)  TCSAYPLSALDTLLFDGRTNWNSVLFTILDGTKEEHLDMDGGIIQKLLE
  iav-Mper partial (231) TCSAYPLSALDTLLFDGRTNWNSVLFTILDGTKEEHLDMDGGIIQKLLE
       iav-Bmor   (332)  TCSAYPLNALDTLLFDGRTNWNSALFTILNGTKQEHLDMDGGIIQRLLE
       iav-Dple   (332)  TCSAYPLNALDTLLFDGRTNWNSALFTILNGTKQEHLDMDGGIIQRLLE
       iav-Aech   (332)  TCSAYPLNALDTLLFDGRTNWNSALFTILNGTKEEHLDMDGGIIQRLLE
       iav-Cflo   (332)  TCSAYPLNALDTLLFDGRTNWNSALFTILNGTKEEHLDMDGGIIQRLLE
       iav-Hsal   (331)  TCSAYPLNALDTLLFDGRTNWNSALFTILNGTKEEHLDMDGGVIQRLLE
       iav-Aflo   (331)  TCSAYPLNALDTLLFDGRTNWNSALFTILNGTKEEHLDMDGGIIQRLLE
       iav-Amel   (331)  TCSAYPLNALDTLLFDGRTNWNSALFTILNGTKEEHLDMDGGIIQRLLE
       iav-Bimp   (331)  TCSAYPLNALDTLLFDGRTNWNSALFTILNGTKEEHLDMDGGIIQRLLE
       iav-Bter   (331)  TCSAYPLNALDTLLFDGRTNWNSALFTILNGTKEEHLDMDGGIIQRLLE
       iav-Mrot   (331)  TCSAYPLNALDTLLFDGRTNWNSALFTILNGTKEEHLNMDGGIIQRLLE
       iav-Sinv   (276)  -------------------------------------------------
       iav-Nvit   (331)  TCSAYPLNALDTLLFDGRTSXNSALFTILNGTKEEHLDMDGGIIQRLLE
  iav-Same partial  (1)  -------------------------------------------------
       iav-Btab   (261)  TCSAYPLNALDTLLFDGRTNWNSALFTILNGTKEEHLDMDGGIIQRLLE
       iav-Eher   (329)  TCSAYPLNALDTLLFDGRTNWNSALFTILNGTKEEHLDMDGGIIQRLLE
       iav-Dpon   (349)  TCSAYPLNALDTLLFDGRTNWNSALFTILNGTKEAHLDMDGGIIQRLLE
       iav-Tcas   (334)  TCSAYPLNALDTLLFDGRTNWNSALFTILNGTKEEHLAMDGGIIQRLLE
       iav-Phum   (330)  TCSAYPLNALDTLLFDGRTNWNSALFTILNGTKEEHLDMDGGIIQRLLE
```

FIGURE 113 - CONTINUATION

```
                        401                                               450
         iav-Aaeg (385) XXXXXXXXXXXXXXXXXXXXXXXXXXXXXXVRVFKEESEE----GSD
         iav-Cqui (385) XXXXXXXXXXXXXXXXXXXXXXXXXXXXXXVHVFKDD--------DD
         iav-Agam (385) XXXXXXXXXXXXXXXXXXXXXXXXXXXXXXVRVFADDEGEEGGDATD
         iav-Ccap (384) XXXXXXXXXXXXXXXXXXXXXXXXXXXXXXRVADDDDEDEIDASSK
         iav-Mdom (384) XXXXXXXXXXXXXXXXXXXXXXXXXXXXXXHDGDDDEEDET---AQ
         iav-Dmel (384) XXXXXXXXXXXXXXXXXXXXXXXXXXXXXXHDGEAEDEDSEGSDAS
         iav-Apis (384) XXXXXXXXXXXXXXXXXXXXXXXXXXXXXXVDQXKPXXGEA------
 iav-Mper partial (281) XXXXXXXXXXXXXXXXXXXXXXXXXXXXXXVDQXKPXXGEA------
         iav-Bmor (382) XXXXXXXXXXXXXXXXXXXXXXXXXXXXXXSAXADAHPNWGL----
         iav-Dple (382) XXXXXXXXXXXXXXXXXXXXXXXXXXXXXXSLXADXDPDWGL----
         iav-Aech (382) XXXXXXXXXXXXXXXXXXXXXXXXXXXXXXADMXAVXQWP------
         iav-Cflo (382) XXXXXXXXXXXXXXXXXXXXXXXXXXXXXXADTXAVXQWP------
         iav-Hsal (381) XXXXXXXXXXXXXXXXXXXXXXXXXXXXXXADMXAEXQWP------
         iav-Aflo (381) XXXXXXXXXXXXXXXXXXXXXXXXXXXXXXNTXAQXXKWP------
         iav-Amel (381) XXXXXXXXXXXXXXXXXXXXXXXXXXXXXXNTXAQXXKWP------
         iav-Bimp (381) XXXXXXXXXXXXXXXXXXXXXXXXXXXXXXNIXATXXEWP------
         iav-Bter (381) XXXXXXXXXXXXXXXXXXXXXXXXXXXXXXNIXATXXEWP------
         iav-Mrot (381) XXXXXXXXXXXXXXXXXXXXXXXXXXXXXXNLXTVXXKWP------
         iav-Sinv (276) ------------------------------------------------
         iav-Nvit (381) XXXXXXXXXXXXXXXXXXXXXXXXXXXXXXADTXAEXAQWP------
 iav-Same partial   (1) ------------------------------------------------
         iav-Btab (311) XXXXXXXXXXXXXXXXXXXXXXXXXXXXXXVDRXQPXXGGD------
         iav-Eher (379) XXXXXXXXXXXXXXXXXXXXXXXXXXXXXXTDRTKPXXGGD------
         iav-Dpon (399) XXXXXXXXXXXXXXXXXXXXXXXXXXXXXXDPXEPXXEWS------
         iav-Tcas (384) XXXXXXXXXXXXXXXXXXXXXXXXXXXXXXDPXESXXTWS------
         iav-Phum (380) XXXXXXXXXXXXXXXXXXXXXXXXXXXXXXDRNKPXXGGT------

451                                               500
         iav-Aaeg (431) GGDGAGTAAPDGVDDDEDIXXTWFXYGFXIAXVMGVLXXVVLGGDEXX
         iav-Cqui (427) ADDTDGVTDSPDTTDDEGIXXTWFXYGFXVAXVMGVLXXVVXQGEXX
         iav-Agam (435) DDDGADDGGPMAVDAVDDDIXXTWVXYGFXVAXVMGVLXXVVLQGDEXX
         iav-Ccap (434) DTKALELATELDED---EYXXQTXVXYCXXFXXXVGVLXXVXFQGDEXX
         iav-Mdom (431) ANAGLQTNDPENEE----YXXQTXVXYCXXLCXXAGVLXXXFQGDEXX
         iav-Dmel (434) AAALLDIQSDEGDSGGGDYNAQTXAXYCXXFXXXVGVLXXVFQGDEXX
         iav-Apis (428) -----------------XXWQXXAXYCFXGXXVGVLXXXVQGGEXL
 iav-Mper partial (325) -----------------XXWQXXAXYCFXGXXVGVLXXXVQGGEXL
         iav-Bmor (428) -----------------EINXARSGLXLAXXLXXXSTXCXXXQGDEXX
         iav-Dple (428) -----------------EVNXARSGIXLACXLXXXSTXCXXXQGDEXX
         iav-Aech (426) -----------------XXXXVXXTAXXCIXXXGVXXXXXVQLGEXI
         iav-Cflo (426) -----------------XXXXVIXTAXXCIXXXGVXXXXXVQLGGEXI
         iav-Hsal (425) -----------------XXXXAAXIAXXCSXXXGVXXXXXVQLGEXI
         iav-Aflo (425) -----------------XXTXVAXTIAXXCIXXXGVXSXXXVQLGEXI
         iav-Amel (425) -----------------XXTXVAXTIAXXCIXXXGVXSXXXVQLGEXI
         iav-Bimp (425) -----------------XXTXVGXMIAXXCTXXVGVLXXXVQLGGEXV
         iav-Bter (425) -----------------XXTXVGXMIAXXCTXXVGVLXXXVQLGGEXV
         iav-Mrot (425) -----------------XXXXVGXTIAXXCIXXLGVLXXXVQLGGEXI
         iav-Sinv (276) ------------------------------------------------
         iav-Nvit (425) -----------------XXXXVXVIAXXCVXXXGVXGXXXQLGGEXV
 iav-Same partial   (1) ------------------------------------------------
         iav-Btab (355) -----------------XWXXAXYGFXVGXXNGVLXXLVGQGEXX
         iav-Eher (423) -----------------XWKXVAXQGFXVAXXLGVLXXVIVQGGEXX
         iav-Dpon (443) -----------------XXFXVXIXFTAXXIXXLNVLXXVVCQGDEXX
         iav-Tcas (428) -----------------XXVXLAXYVCXVGXXLGVLXXLVLQGDEXX
         iav-Phum (424) -----------------SXQXXVXYCFXIGXXLGVLCXXCFQGDEXX
```

FIGURE 113 - CONTINUATION

FIGURE 113 - CONTINUATION

FIGURE 113 - CONTINUATION

```
                      701                                              750
       iav-Aaeg (681) KQEEAKKYLEEYSIGLGP---SDDPRYEIRGVMVIKSKSKTRAKQRKGAV
       iav-Cqui (677) KQEEAKKYLEEYSIGLGP---SDDPRFEIRGVMVIKSKSKTRAKQRKGAV
       iav-Agam (685) TQDDAKRYLEEYSIGLGP---SDDPRYETRGVMVIKSKSKTRAKQRKGAV
       iav-Ccap (681) PQADAKNYLEAYSIPLGP---IDDSGYEVRGVMVIKSKAKTRAKQRKGAV
       iav-Mdom (677) PQADAKNYLEAYSIPLGP---SDDSGFEVRGVMVIKSKSKTRAKQRKGAV
       iav-Dmel (684) PQADAKGYLEAYSIPLGP---SDDSGFEVRGVMVIKSKSKTRAKQSKGAV
       iav-Apis (660) PQKAARNYLEEYSIQLAPG---DDVNPEQRGFMVIKCKSQTRAKQRKGAV
iav-Mper partial (557) PQKAARNYLEEYSIQLAPG---DDVNPEQRGFMVIKCKSQTRAKQRKGAV
       iav-Bmor (662) AQDDAHKYLQEYSIGLGP---SDDPRYEQRAVMVIKSKAKTRAKQRKLAV
       iav-Dple (662) SQEDAHRYLQEYSIGLGP---SDDPRYEQRGVMVIKSKAKTRAKQRKGAV
       iav-Aech (658) SQKDAHNYLQEYSIKLGPGDDPNNPASEQRGVLVIKSKSKTRAKQRKGAV
       iav-Cflo (658) SQKDAHNYLQEYSIKLGPGDDPNNPASEQRGVLVIKSKSKTRAKQRKGAV
       iav-Hsal (657) SQKDAHNYLQEYSIKLGPGDDPNNPASEQRGVLVIKSKSKTRAKQRKGAV
       iav-Aflo (657) SQKDAQNYLQEYSIKLGPGDDPNNPASEQRGVLVIKSKSKTRAKQRKGAV
       iav-Amel (657) SQKDAQNYLQEYSIKLGPGDDPNNAASEQRGVLVIKSKSKTRAKQRKGAV
       iav-Bimp (657) AQKDAQNYLQEYSIKLGPGDDPNNPASEQRGVLVIKSKSKTRAKQRKGAV
       iav-Bter (657) AQKDAQNYLQEYSIKLGPGDDPNNPASEQRGVLVIKSKSKTRAKQRKGAV
       iav-Mrot (657) SQKDAQNYLQEYSIKLGPGDDPNNPASEQRGVLVIKSKSKTRAKQRKGAV
       iav-Sinv (276) --------------------------------------------------
       iav-Nvit (657) SQDDAHNYLQEYSIKLGPGDDPNDPASEQKGVMVIKSKSKTRAKQRKGAV
iav-Same partial (143) --------------------------------------------------
       iav-Btab (586) PAADAHNYLQEYSIKLGPG---DDPSTEGRGVMVIKSKSKTRAKQRKGAV
       iav-Eher (652) NQESCKQYLQEYSIKLGPG---DDPSTEGRGVMVIKSKSKTRAKQRKGAV
       iav-Dpon (675) PQKEAHNYLQEYSISLGP---ADDPATEGKGVMVIKSKNKIRAKQRKGAV
       iav-Tcas (660) PQSDAQHYLQEYSISLGIS--EQDPSTKKKGVLVIKSKSKTRAKQRKGAV
       iav-Phum (655) NQESCHRYLQEYSIKLGIG---DDPSTEGRGVMVIKSKSKTRAKQRKGAV 751                                              800
       iav-Aaeg (728) SNWKSVLRVTLNELKKRNMTGEELRRIMWGRSSITSPAKISKKK------
       iav-Cqui (724) SNWKSVLRVTLNELKKRSMTGEELRRIMWGRSSITSPAKISKKKK-----
       iav-Agam (732) SNWKSVLRVTLNELKKRSMTGEELRRIMWGRSSITSPAKIAKKKR--P--
       iav-Ccap (728) SNWKRVGRVTLNALKKRGMTGEMRRLMWGRASISSSTKITKKKLKDP---
       iav-Mdom (724) SNWKRVGRVTLNALKKRGMTGEEMRRLMWGRASISSSTKVAKKKLKDP---
       iav-Dmel (731) SNWKRVGRVTLFALKKRGMTGEEMRRLMWGRASISSSNKVTKQKLKDP---
       iav-Apis (707) INWKKSGKLVIQELRRLEGTGQNLRDMIWKRSSLSASSPWAKSVSITK--
iav-Mper partial (604) INWKKSGKLVIQELRRLEGTGQNLRDMIWKRSSLSASSPWAKSVSITK--
       iav-Bmor (709) TNWKHVGKVTIAELRRRGISGEELRRLMWGRISISTTTKAPLPRRVPAPP
       iav-Dple (709) SNWKRVGKVTIAELRRRGISGEELRRLMWGRVSISTTTKAPLK---CVPP
       iav-Aech (708) SNWKRVGKVTLLELRKRGMTGEELRRIMWGRASFSTEVRVSPNAGQPQ--
       iav-Cflo (708) ANWKRVGKVTINELRKRGMTGEELRHIMWGRESFSTEVRVSPNAGQPQ--
       iav-Hsal (707) ANWKRVGKVTINELRKRGMTGEELRRIMWDRASISTEVRVSPNVNEPQ--
       iav-Aflo (707) ANWKRVGKVTINELRKRGLTGEELRRIMWGRASFSTEVRVSPKGVEPQ--
       iav-Amel (707) ANWKRVGKVTINELRKRGLTGEELRRIMWGRASFSTEVRVSPKGVEPQ--
       iav-Bimp (707) ANWKRVGKVTINELRKRGITGEALRRVMWGRASFSTEVRTSPNTAEPQ--
       iav-Bter (707) ANWKRVGKVTINELRKRGITGEALRRVMWGRASFSTERDTLRALGSVG--
       iav-Mrot (707) ANWKRVGKVTINELRKRGMTGEELRRIMWGRASFSTEVRVSPNVDEPQ--
       iav-Sinv (276) --------------------------------------------------
       iav-Nvit (707) ANWKRVGKVTIAELRKRGMTGEELRRIMWGRASFSTEVRSSPILMEP---
iav-Same partial (143) --------------------------------------------------
       iav-Btab (633) SNWKRVGKVTINELRKRGMTGEQLNRRIMWGRASISTEVRQP---AMALLL
       iav-Eher (699) ANWKRVGKVTINELRKRGMNGEQLRRIMWDRASISTEVKVPQNPVVDVLM
       iav-Dpon (722) SNWKRVGKVTIFALKKRGMTGEEMRCLMWGRESINTEVKVKGPKR-----
       iav-Tcas (708) ANWKRVGKVTINALKKRGLTGESMRCLMWGRESINTEVKPKKPVK-----
       iav-Phum (702) CNWKRVGKVTIREGFKRGMTGEQLRRLMWGRSSISTEVKPAPIKLGHVTS
```

FIGURE 113 - CONTINUATION

```
                              801                                              850
           iav-Aaeg    (772)  -------------KIYEEEDPFA  N  I V  T Q  V  -----------
           iav-Cqui    (769)  -------------IYDEDEDPFA  A DV  T Q  V  -----------
           iav-Agam    (778)  -----------GEVDDLLGDPFA  A DV  T Q  V  -----------
           iav-Ccap    (776)  -----------YNLNP----QND   AM M  T  N PAA-----------
           iav-Mdom    (772)  -----------YNLNQEPG QSN   AM M N  N PAS-----------
           iav-Dmel    (779)  -----------YNLHT----DSDF  N M M T  SNPAS-----------
           iav-Apis    (755)  ----NKSKSYSE KDDQIRLS A GA L A V H L  T-----------
    iav-Mper partial   (652)  ----NKSKSYSE KDDQIRLS A GA L A V H L  T-----------
           iav-Bmor    (759)  PDCVVSSDVGLA DVGN V PA   SA N   A  T  L  GTT--------
           iav-Dple    (756)  PELVTSEIP------GS V PA   SSA N   A  TC L  TNT--------
           iav-Aech    (756)  -----------V AVTA F DA   A L V A  HD  D -----------
           iav-Cflo    (756)  -----------V AVTA F DA   A L V A  HD  D -----------
           iav-Hsal    (755)  -----------V AVTA F DA   A L V A  HD  D -----------
           iav-Aflo    (755)  -----------V VVTA F DA   T AL V A  HD D  -----------
           iav-Amel    (755)  -----------V VVTA F DA   T AL V  A HD D  -----------
           iav-Bimp    (755)  -----------V AVTA F DA   A L V A  HD  D -----------
           iav-Bter    (755)  -----------IVRAVG-------------------------------
           iav-Mrot    (755)  -----------V AVTA F DA   A L V A  HD D  -----------
           iav-Sinv    (276)  -------------------------------------------------
           iav-Nvit    (754)  -----------V SVPG F DA   SA L  T  A L P  PIEGSIPKPVA
    iav-Same partial   (143)  -------------------------------------------------
           iav-Btab    (680)  EDSEEEN----- ANNT PFG A   A L V A  T  D  NIGQT------
           iav-Eher    (749)  ENTAEQQ----- QQTP SFG A   A L V A  T  L  SASG-------
           iav-Dpon    (767)  DPLANPQGP----DLAN F DA   SA L V A  T  L  N---------
           iav-Tcas    (753)  DPLLDPQGP----NLTG F DA   T AL V  T  H  L  VGA--------
           iav-Phum    (752)  ISGVADITVPETTGNTV T G G L A L V A  TN    FS---------

851                                              900
           iav-Aaeg    (798)  -------V SEPTGPPTIDPSKP--A---------------------
           iav-Cqui    (795)  -------V TEPVGP MIDPTKPPVT----------------------
           iav-Agam    (806)  -------V TDTVCP TIPPAAAPGT----------------------
           iav-Ccap    (800)  --------SAGLQLRSSLMDSGAEGKA---------------------
           iav-Mdom    (800)  --------S GLAFRTSGTQDPKEKK----------------------
           iav-Dmel    (803)  --------SNGVTLRS TAPPPAP-----------------------
           iav-Apis    (791)  -------------------------------------------------
    iav-Mper partial   (688)  -------------------------------------------------
           iav-Bmor    (800)  -----G-SDQKQTTPDLLVNGKTSNAPILTTGTQMPKVSSKTLGTPVARI
           iav-Dple    (791)  -----GSELHKQITPDLLVNGKT-----------PVTAQNTATTPKVPL
           iav-Aech    (783)  -----STA EGIPTN DAKQIKTAQS--------------------KAA
           iav-Cflo    (783)  -----SAA EGIPTN DAKQTKTTQS--------------------KAI
           iav-Hsal    (782)  -----STA EGVPSN DTRQTKAIP-----------------------
           iav-Aflo    (782)  -----STA EGIPTN DAKQSKPKS------------------------A
           iav-Amel    (782)  -----STA EGIPTN DAKQSKPK-------------------------S
           iav-Bimp    (782)  -----STA EGIPTN GAKQSKSKT------------------------A
           iav-Bter    (761)  -----TLGPVGTVRA GALG---P-------------------------
           iav-Mrot    (782)  -----STA ESIPTN DVKQSKPKV------------------------V
           iav-Sinv    (276)  -------------------------------------------------
           iav-Nvit    (792)  VAPGQQPT TLALPNGAAKPQQPMMT--------------------TST
    iav-Same partial   (143)  -------------------------------------------------
           iav-Btab    (719)  ------PV VSGLGG SVRSGAEGL-----------------------
           iav-Eher    (787)  -------I SSGLN----------------------------------
           iav-Dpon    (802)  -----AQGLNLAKQT NPKP----------------------------
           iav-Tcas    (790)  -----SQGLNLATNPKPVPPTTT-------------------------
           iav-Phum    (792)  --------SENQTSTSFKTQPQPS------------------------
```

FIGURE 113 - CONTINUATION

```
                        901                                             950
        iav-Aaeg  (815) ------TIAVKPQTAPAAQPIPEIPPQ------------PPLVKRQSVVS
        iav-Cqui  (814) ------TVKPTAPTVPSAQPAPGVPMTT---AQTAAPTAPQLVKRQSVVS
        iav-Agam  (825) ------AAPKAGGTKPVVVAPPPPAAAT---AVQQPPP-PATTRRHSTAS
        iav-Ccap  (819) ------AKVQEENQQPAPDPLRDLIFLADRRPEMHDPQYFVGLQQLANQA
        iav-Mdom  (818) ---------DVPHIPAPDPLRDLVLLAEEKPEVHDPQFYSALIQLANKA
        iav-Dmel  (819) ---------------PAPDPFRELIMMSDQRPETHDPHYFAGLQQLANKA
        iav-Apis  (791) --------------------------------------------------
iav-Mper partial  (688) --------------------------------------------------
        iav-Bmor  (844) EASSLKTPLDVKLNPTTLTQSTVQGNIGNVNIPISGVKITTNVGQNSAVV
        iav-Dple  (824) VNLPNKAGLDVQSTGSDQSVPTALT----KNMDVLGINMSTQDLLKNQTI
        iav-Aech  (807) LNDQQTKTTQNNPEVVINVQPHNQPIK-EETKLSGLTDLIDKSIDPVKDV
        iav-Cflo  (807) PNDQMKTTQ-NNPETVTNVQPHKQPIG-EPTKLLGLTDLIDNSIGPVKDV
        iav-Hsal  (802) --DEQTRTARNNPKAVTDVQPHKQAIGGEETKLSGLTDLIDMSAAEPARV
        iav-Aflo  (803) IKEQMKLTTNNQENVSTNVEPQLKSTTENANDQANNPREIKKVTNQVTGI
        iav-Amel  (802) ATKETKSTVNNQQNVTTNIEP-LKSTTENVDDQANNPR-EKKVTSQAATV
        iav-Bimp  (803) CKDQAKSATNNQEKGSTDVQQQRKLTTENLDNLASSHNDIDKTSSEFVAV
        iav-Bter  (777) ----VG----------------T------------VRD-------
        iav-Mrot  (803) SSEQTKLTTNNQEKPS----ITEKAATEIANKQVNAKDETNKKPNEVVDV
        iav-Sinv  (276) --------------------------------------------------
        iav-Nvit  (821) TTTTITTTVQKTLVTGTATTPAVGVTKTVAVPAATTVSTTTTRASASAVP
iav-Same partial  (143) --------------------------------------------------
        iav-Btab  (738) --------------------------------------------------
        iav-Eher  (794) --------------------------------------------------
        iav-Dpon  (817) --------------------------------------------------
        iav-Tcas  (808) ------ASAVTVNNQINSALNAQQKAVAGAGVGALAMIGTVTQLTDSQGY
        iav-Phum  (808) ---------E----------------------------------------

951                                            1000
        iav-Aaeg  (847) APPAY--DDFPPMKDYK P R   I E-SP VDDHY QSCKTL ND ST
        iav-Cqui  (855) APPAY--DDFLPAKGFK P R   L E-ST IDEHY QTCRSL TD ST
        iav-Agam  (865) APATMGLGVEAALPGYK P R   I E-SA VDENY QN KTL ID ST
        iav-Ccap  (863) LDLVEQTMGIHPPP--TPATDA  S A-AATTTIGA TMQTATTVA PS
        iav-Mdom  (858) YDLVKKTLETQHQP----Q E P  PLTE-AT LKDVT TKQPDPVAA AG
        iav-Dmel  (854) FDLVEQTMKTQPQAPVAKK DP P A V-AK SPAAP TQATAT AA SD
        iav-Apis  (791) ------LTKDQSIDELH P RC  M ESDKNIDKSQ EI ANA AKIAN
iav-Mper partial  (688) ------LTKDQSIDELH P RC  M ESDKNIDKSQ EI ANA AKIAN
        iav-Bmor  (894) PEIQQSNENQKPEQVHQ Y R   LAE-KP TTNLE KQ AEK ADLRD
        iav-Dple  (870) NNPATAN-----EIVFK Y R   K E-QLGLDNID KA AEK ANLTD
        iav-Aech  (856) EAMNLRNMNQTKALEE--T ED P  ELA-IA ETTTDYKT LQI KS LA
        iav-Cflo  (855) EAMNLKNTNQTKALEASMEF E DP  ELA-IA ETTTNYEI LQI KS LA
        iav-Hsal  (850) EAMNLKNASQAKAHEG--A E P  ELA-IA ETTEDYDT LQM KS LA
        iav-Aflo  (853) HEMNLKNA---NHSSVT DF Q P  ELV-IA ENTNDPET LEI KR AA
        iav-Amel  (850) HEMNLKNA---NHSSVT DF Q P  ELV-IA ENTNDPET LEI KR AA
        iav-Bimp  (853) REMNSKNA---SHSSMA DF Q P  ELV-IA ENTDDPET LKI ER AA
        iav-Bter  (783) ------------SSMA DF Q P  ELV-IA ENTDDPET LKI ER AA
        iav-Mrot  (849) EKMNVKNA---NNSSTV EYH    EFV-IA ESMNDPET LKM ERVAA
        iav-Sinv  (276) --------------------------------------------------
        iav-Nvit  (871) PTVRPSELGPASAPCSA P L   ATE-DPGSSEET QR AHS RIVGE
iav-Same partial  (143) --------------------------------------------------
        iav-Btab  (738) ---------PPEQPFH PF RQ  E E-NPHIDESE AA ANA AM VV
        iav-Eher  (794) ---------AKELIVS PF R   S E-IDVGEE-E AT AEA VL VM
        iav-Dpon  (817) ---------------FT P RT  E  --LVETNSAR SV AAQ ANLPD
        iav-Tcas  (852) IMQNSVKKEEKIVATLE PF R   N N-DSNCDPEK KM ALS ANLKD
        iav-Phum  (809) -----VSCVESDSNSDPLYNDP RQLNE-ELNKTREE LT ARV ANNDG
```

FIGURE 113 - CONTINUATION

```
                       1001                                              1050
        iav-Aaeg (894) LDHDTLG--------QLNPFLEAKDVVDPVKERE----------------
        iav-Cqui (902) LDHEEHQQQQQQTVGQLNPFLDAKDVVDPVKERE----------------
        iav-Agam (914) LDHNPKD-----------------VVDPVRERE-----------------
        iav-Ccap (910) ADLITPLGAN-----LTTIFQDNKDVVDPQKLQE----------------
        iav-Mdom (903) LLGDMAMGAN-----LTNIFQDPKDIVDPKKLEQ----------------
        iav-Dmel (903) LMAMPLPISN-----LSNIFQDPKDIVDPKKLEE----------------
        iav-Apis (835) QDSIKP-----------ISINLEQQNDVKNEK------------------
iav-Mper partial (732) QDSIKP-----------ISVNLEQXXXXXXX-------------------
        iav-Bmor (943) VPRIDININMAAKSARKMVAGAVSGLFGVAADTPAP------------DA
        iav-Dple (913) VPRIDINISTAARSARRVVAGAVSGLFGVTAETPR-------------DA
        iav-Aech (903) TSEASM----KTTIDPQIIAHFAMVAPPTIEKS----------------S
        iav-Cflo (904) ASEASV----KTAIDPQIIAHFAMIPPPITEK-----------------F
        iav-Hsal (897) TSEAS------TTVDPQIIAHFTMIAPPPVEKP----------------I
        iav-Aflo (899) GFSTEA----SSKINLQIIEQFTMTKIPMEEKV----------------S
        iav-Amel (896) GFSTET----SSKINLQIIEQFTMTKIPMDEKV----------------N
        iav-Bimp (899) NFRVES----SSKINLQIIEQFTMTKIPMEEKV----------------A
        iav-Bter (819) NFRVES----SSKINLQIIEQFTMTKIPMEEKV----------------A
        iav-Mrot (895) EFRSSA----NPKINLQIIEQFTMTKIPMEEQA----------------A
        iav-Sinv (276) --------------------------------------------------
        iav-Nvit (920) SATTSA----KSDIDSSFIERLALGGIGLAAMPEQPDKPVEPKKKQYLAL
iav-Same partial (143) --------------------------------------------------
        iav-Btab (777) AP-DDI--------PTPVVTPEPVSAIPRLPS------------------
        iav-Eher (832) SGQSDE--------SEKLKIAKFNKQISFEQN------------------
        iav-Dpon (850) TAIIVS-CPNTATTSVKNIAGIFAGTGNFVKKIEEK------------VK
        iav-Tcas (901) VEILS--VAKPQTKSVKSIAGIFAGTETFVRKVEET------------IK
        iav-Phum (853) IERIPPQICQYGWINNYNFFGNTFAQNQKVEDP--------------VQQ 1051                                              1100
        iav-Aaeg (920) FLKTLEAIDTDSEAAEKPVLGKISLRRAKSAVSRTTSRKKKTDQHPLF
        iav-Cqui (936) FLKTLEAIDTDSEAAEKPVLGKISLRRARSAVSRTTSRKKKTDQHPLF
        iav-Agam (930) FLKTLEAIDTDSEAEKPVLGKISLRRAKSAVSESTSRKRKTDQHPLF
        iav-Ccap (939) FLKMLAEIETEESDGSGRPIIGKLSLSRTKSALSKAQIKKDTVGGS--P
        iav-Mdom (932) FLKMVADVETEESDGGG-PIIGKLSLARTRNALFKVPIPKSTLGDS--S
        iav-Dmel (932) FMAMLAEVETEESDSIG-PIIGKLSLAKRTHNALSRAEIRRDQQGFEGHS
        iav-Apis (856) -----TKIPISSNTITNRKILNKQSKNLSMYGFESQDMIVDKYS------
iav-Mper partial (752) -----XXXXXXXXTITNRKILNKQSKNLSMYGFESQDIIVDKYS------
        iav-Bmor (981) GWRRDRHDNSDSDPISESVLLSRASRARRASKSREAAPPP---------
        iav-Dple (950) GWRRERHEHIDSDPVPECVLLGRAARARRSRSASREAPPPP--------
        iav-Aech (933) IVKKQYFMESSDNDLGGDNLLGTEARLILIKSANNRFTIS---------
        iav-Cflo (933) IVKKQYFMESSDNDVGGDNLLGTEARLRRIKSANNRFIITS--------
        iav-Hsal (925) VVKKQYLVESSDNDLGGDNLLGTEARLIRIKSANDRFISTS--------
        iav-Aflo (929) VTKKQYFVESSDNDFGGDNLLGTEARLRRIRSANNRFIITR--------
        iav-Amel (926) VTKKQYFVESSDNDFGGDNLLGTEARLRRIRSANNRFIITR--------
        iav-Bimp (929) ATKKQYFVESSDNDFGGDNLLGTEARLRRIRSANNRFIITR--------
        iav-Bter (849) ATKKQYFVESSDNDFGGDNLLGTEARLRRIRSANNRFIITR--------
        iav-Mrot (925) AVKKQYFIESSDNDFGGDNLLGTVARLRRIRSANSRFIIAR--------
        iav-Sinv (276) --------------------------------------------------
        iav-Nvit (966) KSSLKSDRASLQHPLSHDGQIGTEARLIIIRSASSILAPTTTSTSRR--
iav-Same partial (143) --------------------------------------------------
        iav-Btab (800) ----LHLEPIDSDGLIDGPIIRGSRVIVNRIHLKQQKASSTN------
        iav-Eher (856) ----AVLEVIDSDGFLDGQPIIQGSIAIRVKSIQERQRAEITWG------
        iav-Dpon (887) KKIYAVLECIDSESFIG--KCHGISTHFQSILKYCRSAAG---------
        iav-Tcas (937) KK-YAALDPIDSEGFIEPPIIKISRTIRAKSANLINSIAR---------
        iav-Phum (889) PTFQSTPNHIDSDGLIDGLIIGSNRILIKTIRSANIIRKFSGSS------
```

FIGURE 113 - CONTINUATION

```
                         1101                                          1150
      iav-Aaeg   (970)   TIAWDDKNLTR---------------THPEDFGALNTAYEYSAEDFKQDV
      iav-Cqui   (986)   MIAWDDKTTTIPGGGPQAVSATAGTAAPEDDFGALNTAYECSAEDLKHDV
      iav-Agam   (980)   MIAWEDKGDQQR------------------HSTALYDGATGAAPSVGAP
      iav-Ccap   (987)   DKLIPSVWSHNLPQPDEEPE--------FNFEAALAEEHTLTIEQESEVE
      iav-Mdom   (979)   DKLINSVWDKVPADNDEDSIP-------AFDFQEALAEHVLTVEQEADVE
      iav-Dmel   (981)   HGQFQPMSSVWAPPGLDVDT--------GFHFDEAVAEEVLTIEQESEVE
      iav-Apis   (895)   ----------------------------------KAIAITRSISTQTG
iav-Mper partial (791)   ----------------------------------KEIVITRSISTQTG
      iav-Bmor  (1022)   ----------------------------------PHLYVPARSMYLVA
      iav-Dple   (991)   ----------------------------------PHLYVPAR------
      iav-Aech   (973)   -----------------------------KRSRRDDDGDSSSTTS
      iav-Cflo   (974)   -----------------------------KRPHRDDDGDSSSTIS
      iav-Hsal   (966)   -----------------------------KRSHHDDDNDSSSVTS
      iav-Aflo   (970)   -----------------------------RRSRNVDDDLSSSSTS
      iav-Amel   (967)   -----------------------------RRSRNVDDDLSSSSTS
      iav-Bimp   (970)   -----------------------------RRSRHTDDDLSSSSTS
      iav-Bter   (890)   -----------------------------RRSRHTDDDLSSSSTS
      iav-Mrot   (966)   -----------------------------RHSRHVNDDMSSSSAS
      iav-Sinv   (276)   --------------------------------------------------
      iav-Nvit  (1014)   --------------------------KSGQQKQQREARDDESTSAAS
iav-Same partial (143)   --------------------------------------------------
      iav-Btab   (840)   -------------------------------GNGYSDRQRLFSKN
      iav-Eher   (896)   -------------------------------GTSISSIE-------
      iav-Dpon   (926)   -------------------------------DNITGEE-----GQ
      iav-Tcas   (977)   -------------------------------SKASDKKKLVGSQ
      iav-Phum   (932)   -------------------------------TNEKNLLEPEDSSTNS 1151                                          1200
      iav-Aaeg  (1005)   DSEA---REEEEDEGVTVEEVHRRMEELHHR-GRASLERDSNSTESSKKH
      iav-Cqui  (1036)   DSEA---REDDPDEGVTVEEVHRRMERFHQRPGRSSPERDSNSTESSK--
      iav-Agam  (1011)   GSLG---QPEQPEDAVTVEELHRRMEQFHQR--ASVRERDANSSESGS--
      iav-Ccap  (1029)   TSTG--NEREDSEDCPTVEEVHATMKQFHLRKRQYQQDDAASRAKSARIK
      iav-Mdom  (1022)   TSDANDDSGETMDDIPTAEEVHATMKQFHLRKRQYQQDDAASRAKTARIR
      iav-Dmel  (1023)   TSDG--NGGQDSEDIPTAEEVHATMKQFHLRKCQPAQDEAASRAKSARVR
      iav-Apis   (909)   GIGIIEKNERQIIRPKTAKINRVTPTQNFAVKRGQSAQPDKSEDHRDN--
iav-Mper partial (805)   GIGIIEKNERPIIRPKTAKINRVTPTQNFAVKRGQSAQPDKSEDHRDN--
      iav-Bmor  (1036)   SSSSAIESDAPWDDQPSSENNSAVGGRREEIAHIKAARPLCIQHAASG--
      iav-Dple   (999)   --------------------------------------------------
      iav-Aech   (990)   VSQSL-RYRPLLNDPEQRPMNRI-ETEGR-KTTVETIKPEVSQNG-----
      iav-Cflo   (991)   ISRNQ-RYRPLFNDPEERSINHV-ETEGQ-KTPMETIKSEIQQNG-----
      iav-Hsal   (983)   VSRSQPQYRPLLNDSEESLANRV-ENEGRRTSDVETIKSEVSQNGRGG--
      iav-Aflo   (987)   MSRNP-RYQSLFNG-HENSIDR--PIESR-ECSMEAINSQISQNGPP---
      iav-Amel   (984)   MSRNP-RYQSLLNG-HENSIDR--PIESR-ECSIEAINSQISQNGP----
      iav-Bimp   (987)   ASRNP-QYQPLLNG-PENLASR--QIESR-ESSIEAIKPQVSQNGS----
      iav-Bter   (907)   ASRNP-QYQPLLNG-PENLVSR--QIESR-ESSIEAIKPQVSQNGS----
      iav-Mrot   (983)   GSGNP-RYQQLLND-TEEVPSNQ-RTENR-DESIVANKSEVSQNDAN---
      iav-Sinv   (276)   --------------------------------------------------
      iav-Nvit  (1036)   LSNIS-GYQPLLNEPDTTADQPATGTEDNKPANGRNLRKRPSTTSNEGKV
iav-Same partial (143)   --------------------------------------------------
      iav-Btab   (855)   ESSSS---NTSLDFDLTNPPSQLRLTPPPRPVTAEIVAVNPSKYIG----
      iav-Eher   (904)   -------------EPPPYLPLPPPP----------P--------
      iav-Dpon   (935)   TSTYATFCKQEKEFR--------------------------------
      iav-Tcas   (991)   SSSTDTVNNEINEKNIENSDLDYAEERIKLVKESLKQVVDVAQIRPIN--
      iav-Phum   (949)   ESFSCLTENYINKNIKVNANFSENSLRSNRSSANLVVKKFGSRSG-----
```

FIGURE 113 - CONTINUATION

```
                        1201                                              1250
        iav-Aaeg (1051) PHRKRQGMGRGRNNKVSPDTSNESVSG--------------KKDKRMKSAP
        iav-Cqui (1081) -K-----Q-------AKGDKRMKSAPS-------------GHGPRHRQMM
        iav-Agam (1054) --------GKQHAGPKARKPAGSSAGG-------------RTVAPGGARP
        iav-Ccap (1077) -----------RKNRISPEQSHECDDGSSGGGGGKSTHPRGASAPGRKHT
        iav-Mdom (1072) -----------RKNKVAPDYAGSEEQ-----------YGRGRSAPMKKKH
        iav-Dmel (1071) -----------RRNKVSPEQSDDPDE---------------RSQRGRSAY
        iav-Apis  (957) ---------------------------------------K---------EQ
iav-Mper partial (853) ---------------------------------------K---------EQ
        iav-Bmor (1084) ----RTAQVEHSLFVVGPGTGAEVESTPTVQKSEKKARPKTTRSRRNRIS
        iav-Dple  (999) --------------------------------------------------
        iav-Aech (1032) ------SIPTKPLDKIQKRRPKTAKNRVSPKETEEPARRR-ESIERN-KA
        iav-Cflo (1033) ------SIPLKPPDKIQKRRPKTAKNRVSPKEIEEPRRR--ESIEQN-KA
        iav-Hsal (1030) ---GGGGVSKPSDKRVQKRRPKTAKNRVSPKEIEEPARRREESIERNKAA
        iav-Aflo (1029) --------CETVKAKVQKKRPKTAKNRVSPKEIEKAGPRRRESIERN-KA
        iav-Amel (1025) --------CETMKAKVQKRRPKTARNRVSPKEIEKAGPRRRESIERN-KA
        iav-Bimp (1028) --------CDSVKIKVQKRRPKTAKNRVSPKEIEEAGPRRRESIERN-KA
        iav-Bter  (948) --------CDSVKIKVQKRRPKTAKNRVSPKEIEEAGPRRRESIERN-KA
        iav-Mrot (1026) --------CGSRCKAQ-KRRPKTARNRVSPKETEDSGQRRRESMERN-KA
        iav-Sinv  (276) --------------------------------------------------
        iav-Nvit (1085) FCSRRTIVVLNKNKKNKKLETSEANMNARKKETLLALHDMTSLISDNWIQ
iav-Same partial (143) --------------------------------------------------
        iav-Btab  (898) -----------GNSQERLRPKTAKVNRVAPTPDVPVRRG----ISANGI
        iav-Eher  (917) -----------LHSHQRPRPKTAKPNRVVPEAVVAKRP------QSSAL
        iav-Dpon  (950) --------------------------------------------------
        iav-Tcas (1039) ----IDVALEEQVSVTISETMRVQGSGDGAEVQSSNVKPKRKKRSKTAKN
        iav-Phum  (994) ---------------------LKSSTNRIAPADLSPVGNVSKYSETLCN 1251                                              1300
        iav-Aaeg (1088) TGGGTSPPDLEEWSTKDICNIKKIDTDTQDE-----------------
        iav-Cqui (1105) DTGGGSPPDLEEWSTKEIVPINKIDTDTQDE-----------------
        iav-Agam (1083) DDGTGSPPDLEEWSTKNIMNINKIDQDTTEE-----------------
        iav-Ccap (1116) VSERLSPPDLEEWSTRELQNINKIARK---------------------
        iav-Mdom (1100) DEDEMSPPDLEEWSTRELQNINKIAKK---------------------
        iav-Dmel (1095) TRRTQSPPDLEEWSTRELQDINKIARK---------------------
        iav-Apis  (960) QCYCISGNNMRDNSTQDLAPINTIKNNGPNDDF---------------
iav-Mper partial (856) QCYCISGNNMRDNSTQDLAPINTIKNNGPNDDF---------------
        iav-Bmor (1130) PTPVQEAGSSEEWATAQLSKICRIIRYSSSSAASITSQTSTEQEQSPRY
        iav-Dple  (999) --------------------------------------------------
        iav-Aech (1074) ASPPTSSIDEEWSTRGITDMNTILAWRENAPDSP--------------
        iav-Cflo (1074) ASPPTSSIDEEWSTRGITDMNTILAWRDNAPDSP--------------
        iav-Hsal (1077) LSPPAPSIDEEWSTRGITDMNTILAWRENAPDSP--------------
        iav-Aflo (1070) VSPATSITDEEWSTRGIKDMNTILAWEETAPDSP--------------
        iav-Amel (1066) VSPATSFTDEEWSTRGIKDMNTILAWEETAPDSP--------------
        iav-Bimp (1069) VSPATSITDEEWSTRGIKDMNTILAWEENTPDSP--------------
        iav-Bter  (989) VSPATSITDEEWSTRGIKDMNTILAWEENTPDSP--------------
        iav-Mrot (1066) VSPATSITDEEWSTRGIKDMNTILAWEENVPDSP--------------
        iav-Sinv  (276) --------------------------------------------------
        iav-Nvit (1135) INIARFQNNYSHSKVTKNIKKCHLHIESDVLLTSQQCCINISNSKAKMNQ
iav-Same partial (143) --------------------------------------------------
        iav-Btab  (932) PESLPSPPDLEEWSTENIVNMRAIAWQQSDQDSL--------------
        iav-Eher  (949) GDRVKSPPELEEWSTRGIATINTIAWQPSDQDSM--------------
        iav-Dpon  (950) --------------------------------------------------
        iav-Tcas (1085) NK------------------------------------------------
        iav-Phum (1022) SYCITSSSDVIYQWSIRGITNMRTILGLENEDSM--------------
```

FIGURE 113 - CONTINUATION

```
                             1301                                              1350
         iav-Aaeg    (1121) --------------------------------------------------
         iav-Cqui    (1138) --------------------------------------------------
         iav-Agam    (1116) --------------------------------------------------
         iav-Ccap    (1145) --------------------------------------------------
         iav-Mdom    (1129) --------------------------------------------------
         iav-Dmel    (1124) --------------------------------------------------
         iav-Apis     (994) --------------------------------------------------
    iav-Mper partial  (890) --------------------------------------------------
         iav-Bmor    (1180) --------------------------------------------------
         iav-Dple     (999) --------------------------------------------------
         iav-Aech    (1110) --------------------------------------------------
         iav-Cflo    (1110) --------------------------------------------------
         iav-Hsal    (1113) --------------------------------------------------
         iav-Aflo    (1106) --------------------------------------------------
         iav-Amel    (1102) --------------------------------------------------
         iav-Bimp    (1105) --------------------------------------------------
         iav-Bter    (1025) --------------------------------------------------
         iav-Mrot    (1102) --------------------------------------------------
         iav-Sinv     (276) --------------------------------------------------
         iav-Nvit    (1185) ALLVVLSFFVVNEDQPVAGWTWGKSATSSSNNSINDDRARYCRICASHTM
    iav-Same partial  (143) --------------------------------------------------
         iav-Btab     (968) --------------------------------------------------
         iav-Eher     (985) --------------------------------------------------
         iav-Dpon     (950) --------------------------------------------------
         iav-Tcas    (1087) --------------------------------------------------
         iav-Phum    (1056) --------------------------------------------------

1351                                              1400
         iav-Aaeg    (1121) --------------------------------------------------
         iav-Cqui    (1138) --------------------------------------------------
         iav-Agam    (1116) --------------------------------------------------
         iav-Ccap    (1145) --------------------------------------------------
         iav-Mdom    (1129) --------------------------------------------------
         iav-Dmel    (1124) --------------------------------------------------
         iav-Apis     (994) --------------------------------------------------
    iav-Mper partial  (890) --------------------------------------------------
         iav-Bmor    (1180) --------------------------------------------------
         iav-Dple     (999) --------------------------------------------------
         iav-Aech    (1110) --------------------------------------------------
         iav-Cflo    (1110) --------------------------------------------------
         iav-Hsal    (1113) --------------------------------------------------
         iav-Aflo    (1106) --------------------------------------------------
         iav-Amel    (1102) --------------------------------------------------
         iav-Bimp    (1105) --------------------------------------------------
         iav-Bter    (1025) --------------------------------------------------
         iav-Mrot    (1102) --------------------------------------------------
         iav-Sinv     (276) --------------------------------------------------
         iav-Nvit    (1235) CLFPYDDPGPKCAAVENGDLEPEEIEWILQRHNSLRDGIARAWKSQYRPL
    iav-Same partial  (143) --------------------------------------------------
         iav-Btab     (968) --------------------------------------------------
         iav-Eher     (985) --------------------------------------------------
         iav-Dpon     (950) --------------------------------------------------
         iav-Tcas    (1087) --------------------------------------------------
         iav-Phum    (1056) --------------------------------------------------
```

FIGURE 113 - CONTINUATION

```
                          1401                                              1450
        iav-Aaeg  (1121)  --------------------------------------------------
        iav-Cqui  (1138)  --------------------------------------------------
        iav-Agam  (1116)  --------------------------------------------------
        iav-Ccap  (1145)  --------------------------------------------------
        iav-Mdom  (1129)  --------------------------------------------------
        iav-Dmel  (1124)  --------------------------------------------------
        iav-Apis   (994)  --------------------------------------------------
iav-Mper partial   (890)  --------------------------------------------------
        iav-Bmor  (1180)  --------------------------------------------------
        iav-Dple   (999)  --------------------------------------------------
        iav-Aech  (1110)  --------------------------------------------------
        iav-Cflo  (1110)  --------------------------------------------------
        iav-Hsal  (1113)  --------------------------------------------------
        iav-Aflo  (1106)  --------------------------------------------------
        iav-Amel  (1102)  --------------------------------------------------
        iav-Bimp  (1105)  --------------------------------------------------
        iav-Bter  (1025)  --------------------------------------------------
        iav-Mrot  (1102)  --------------------------------------------------
        iav-Sinv   (276)  --------------------------------------------------
        iav-Nvit  (1285)  PARDMMQVFWDEELAKIARRWALQCNIHEKDQCRDVEEFSVAQSVSALDL
iav-Same partial   (143)  --------------------------------------------------
        iav-Btab   (968)  --------------------------------------------------
        iav-Eher   (985)  --------------------------------------------------
        iav-Dpon   (950)  --------------------------------------------------
        iav-Tcas  (1087)  --------------------------------------------------
        iav-Phum  (1056)  --------------------------------------------------

1451                                              1500
        iav-Aaeg  (1121)  --------------------------------------------------
        iav-Cqui  (1138)  --------------------------------------------------
        iav-Agam  (1116)  --------------------------------------------------
        iav-Ccap  (1145)  --------------------------------------------------
        iav-Mdom  (1129)  --------------------------------------------------
        iav-Dmel  (1124)  --------------------------------------------------
        iav-Apis   (994)  --------------------------------------------------
iav-Mper partial   (890)  --------------------------------------------------
        iav-Bmor  (1180)  --------------------------------------------------
        iav-Dple   (999)  --------------------------------------------------
        iav-Aech  (1110)  --------------------------------------------------
        iav-Cflo  (1110)  --------------------------------------------------
        iav-Hsal  (1113)  --------------------------------------------------
        iav-Aflo  (1106)  --------------------------------------------------
        iav-Amel  (1102)  --------------------------------------------------
        iav-Bimp  (1105)  --------------------------------------------------
        iav-Bter  (1025)  --------------------------------------------------
        iav-Mrot  (1102)  --------------------------------------------------
        iav-Sinv   (276)  --------------------------------------------------
        iav-Nvit  (1335)  QDAGNRSEMERLKFHLRSWYSQLEPDFSNSAGVGLATPSVTNVGCGRATY
iav-Same partial   (143)  --------------------------------------------------
        iav-Btab   (968)  --------------------------------------------------
        iav-Eher   (985)  --------------------------------------------------
        iav-Dpon   (950)  --------------------------------------------------
        iav-Tcas  (1087)  --------------------------------------------------
        iav-Phum  (1056)  --------------------------------------------------
```

FIGURE 113 - CONTINUATION

```
                           1501                                              1550
        iav-Aaeg  (1121)  --------------------------------------------------
        iav-Cqui  (1138)  --------------------------------------------------
        iav-Agam  (1116)  --------------------------------------------------
        iav-Ccap  (1145)  --------------------------------------------------
        iav-Mdom  (1129)  --------------------------------------------------
        iav-Dmel  (1124)  --------------------------------------------------
        iav-Apis   (994)  --------------------------------------------------
 iav-Mper partial  (890)  --------------------------------------------------
        iav-Bmor  (1180)  --------------------------------------------------
        iav-Dple   (999)  --------------------------------------------------
        iav-Aech  (1110)  --------------------------------------------------
        iav-Cflo  (1110)  --------------------------------------------------
        iav-Hsal  (1113)  --------------------------------------------------
        iav-Aflo  (1106)  --------------------------------------------------
        iav-Amel  (1102)  --------------------------------------------------
        iav-Bimp  (1105)  --------------------------------------------------
        iav-Bter  (1025)  --------------------------------------------------
        iav-Mrot  (1102)  --------------------------------------------------
        iav-Sinv   (276)  --------------------------------------------------
        iav-Nvit  (1385)  SVAIDDSDVAAAVEVLVCNYGPIDDPETEDDSGCETRSRRYSELCQLTRR
 iav-Same partial  (143)  --------------------------------------------------
        iav-Btab   (968)  --------------------------------------------------
        iav-Eher   (985)  --------------------------------------------------
        iav-Dpon   (950)  --------------------------------------------------
        iav-Tcas  (1087)  --------------------------------------------------
        iav-Phum  (1056)  --------------------------------------------------

1551
        iav-Aaeg  (1121)  - (SEQ ID NO: 84)
        iav-Cqui  (1138)  - (SEQ ID NO: 85)
        iav-Agam  (1116)  - (Residues 1-916, 954-1102, & 1167-1216 of SEQ ID NO: 86)
        iav-Ccap  (1145)  - (SEQ ID NO: 83)
        iav-Mdom  (1129)  - (SEQ ID NO: 82)
        iav-Dmel  (1124)  - (SEQ ID NO: 81)
        iav-Apis   (994)  - (SEQ ID NO: 101)
 iav-Mper partial  (890)  - (SEQ ID NO: 104)
        iav-Bmor  (1180)  - (SEQ ID NO: 100)
        iav-Dple   (999)  - (SEQ ID NO: 99)
        iav-Aech  (1110)  - (SEQ ID NO: 92)
        iav-Cflo  (1110)  - (SEQ ID NO: 98)
        iav-Hsal  (1113)  - (SEQ ID NO: 93)
        iav-Aflo  (1106)  - (SEQ ID NO: 90)
        iav-Amel  (1102)  - (SEQ ID NO: 89)
        iav-Bimp  (1105)  - (SEQ ID NO: 94)
        iav-Bter  (1025)  - (SEQ ID NO: 95)
        iav-Mrot  (1102)  - (SEQ ID NO: 88)
        iav-Sinv   (276)  - (SEQ ID NO: 102)
        iav-Nvit  (1435)  E (SEQ ID NO: 112)
 iav-Same partial  (143)  - (SEQ ID NO: 103)
        iav-Btab   (968)  - (SEQ ID NO: 105)
        iav-Eher   (985)  - (SEQ ID NO: 106)
        iav-Dpon   (950)  - (SEQ ID NO: 96)
        iav-Tcas  (1087)  - (SEQ ID NO: 87)
        iav-Phum  (1056)  - (SEQ ID NO: 91)
```

METHODS FOR DETERMINING MODULATORS OF INSECT TRANSIENT RECEPTOR POTENTIAL V (TRPV) CHANNEL

RELATED APPLICATIONS

This application is a national stage application under 35 U.S.C. § 371 of PCT/IB2014/003205, filed Dec. 19, 2014, which claims the benefit of U.S. provisional application No. 61/920,201, filed Dec. 23, 2013, which is hereby incorporated by reference in its entirety.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Sequence_Listing_PF76348_02. The size of the text file is 620 KB, and the text file was created on Jan. 5, 2015.

BACKGROUND

The present invention generally relates to methods for determining agents that modulate a biological activity of an insect transient receptor potential V (TRPV) channel in a cell. The present invention also relates to compositions and methods of insect control as well as vectors encoding an insect TRPV channel and cells comprising an insect TRPV channel.

Almost all field crops, plants, and commercial farming areas are susceptible to attacks by plant insect pests. Plant insect pests are a major factor in the loss of the world's commercially important agricultural crops resulting both, in economic hardship to farmers and nutritional deprivation for local populations in many parts of the world. In other words, insect pests cause great loses and damages to human agriculture, food supply, post-harvest storage, horticulture, animal health and public health.

While advances have been made in the control of these insects, these insects have been able to adopt and evade the control measures. As a result, there remains a need for better understanding of the mechanisms that underlie feeding and other behaviors of insect pests. Such knowledge would allow for the design of agents and strategies for intervening or preventing attacks on all field crops, plants, and commercial farming areas by the insect pests.

Broad spectrum chemical pesticides and insecticides have been used extensively to control or eradicate plant insect pests of agricultural importance. There is, however, substantial interest in identifying and/or developing effective alternative insecticides. As such, effective methods for screening of the new insecticides would be desirable.

What are needed, then, are new methods that can be employed in screening for agents that modulate insect behavior, and in some cases, screening for agents that can act as insecticides.

SUMMARY

In one embodiment, the present invention relates to a method for determining whether or not a candidate compound is a modulator of an insect transient receptor potential V (TRPV) channel. The method includes providing a first cell expressing an insect TRPV channel, contacting the first cell with a candidate compound, and assaying for a modulation of insect TRPV channel, wherein the modulation identifies the candidate compound as the modulator of the insect TRPV channel. For example, in certain embodiments, the assaying step may include at least one of the following steps: (1) detecting calcium ion mobilization in the first cell in response to the candidate compound, (2) detecting a membrane potential in the first cell in response to the candidate compound, (3) comparing calcium ion mobilization in the first cell in the absence of the candidate compound with calcium ion mobilization in the first cell in the presence of the candidate compound, (4) comparing a membrane potential in the first cell in the absence of the candidate compound with a membrane potential in the first cell in the presence of the candidate compound, (5) comparing calcium ion mobilization in the first cell in the presence of the candidate compound with calcium ion mobilization reference level indicative of no modulation of the TPRV channel, and/or (6) comparing a membrane potential in the first cell in the presence of the candidate compound with a membrane potential reference level indicative of no modulation of the TPRV channel. Preferably, the candidate compound may modulate the calcium ion mobilization or the membrane potential in the first cell by at least 20% relative to the reference level. The candidate compound may be a modulator that inhibits the activity of the insect TRPV channel. Alternatively, the candidate compound may be a modulator that activates the insect TRPV channel. The candidate compound may be a modulator that inhibits insect feeding behavior. In the method, the first cell preferably co-expresses an insect Nanchung and Inactive proteins. The ratio of the Nanchung to Inactive proteins co-expressed in the first cell is, preferably, about 3:1 to about 1:3, more preferably about 1:1, or 1:1. The candidate compound may be a small organic molecule, small inorganic molecule, polysaccharides, peptides, proteins, nucleic acids, an extract made from biological materials, and any combination thereof. The method may further include additional steps: providing a second cell expressing a mammalian TRPV channel; contacting the second cell with a candidate compound; assaying for a modulation of mammalian TRPV channel; and comparing the modulation of the insect TRPV channel with the modulation of the mammalian TRPV channel, wherein an increased modulation of the insect TRPV channel relative to the mammalian TRPV channel identifies the candidate compound as a selective modulator of the insect TRPV channel. The candidate compound may modulate the activity of the insect TRPV channel by at least 10% relative to the mammalian TRPV channel. The insect may be an agricultural/horticultural pest or a disease vector or a parasite.

In another embodiment, the present invention relates to a compound selected by the method described above. The compound may be a modulator that inhibits the activity of the insect TRPV channel. The compound may be a modulator that inhibits a feeding behavior of an insect.

In another embodiment, the present invention relates to a method of insect control that includes applying to an insect a compound selected by the method described herein or a compound selected by the method described above. The compound may be an inhibitor of an insect TRPV channel. The compound may be an activator of an insect TRPV channel. The insect may be an agricultural/horticultural pest or a disease vector or a parasite.

In another embodiment, the present invention relates to an expression vector that includes a nucleic acid molecule encoding an insect TRPV channel.

In yet another embodiment, the present invention relates to an expression vector system that includes a first expression vector comprising a first nucleic acid molecule encoding a Nanchung protein, and a second expression vector comprising a second nucleic acid molecule encoding an Inactive protein. Upon co-expression in a cell of the first and the second expression vectors, an insect TRPV channel is formed. The first and the second expression vectors may further comprise a regulatable promoter system, where the regulatable promoter system may include at least one Tet repressor binding site. The regulatable promoter may be a minimal cytomegalovirus promoter operably linked to the nucleic acid molecule encoding an insect TRPV channel. The promoter system may be regulatable by tetracycline or doxycycline. The first and the second expression vectors may further include an adenovirus core origin. Preferably, the first nucleic acid molecule includes a nucleic acid sequence of SEQ ID NO: 2. Preferably, the second nucleic acid molecule includes a nucleic acid sequence of SEQ ID NO: 28.

In another embodiment, the present invention relates to an expression vector that includes a first nucleic acid molecule encoding a Nanchung protein and a second nucleic acid molecule encoding an Inactive protein. Upon expression in a cell an insect TRPV channel is formed. The expression vector may further include a regulatable promoter system, wherein the regulatable promoter system may include at least one Tet repressor binding site. The regulatable promoter may be a minimal cytomegalovirus promoter operably linked to the nucleic acid molecule encoding an insect TRPV channel. The promoter system may be regulatable by tetracycline or doxycycline. The expression vector may further include an adenovirus core origin.

In another embodiment, the present invention relates to an expression vector system. The expression vector system includes a first expression vector comprising a first nucleic acid having SEQ ID NO: 2 encoding a Nanchung protein of the TRPV channel and a second expression vector comprising a second nucleic acid having SEQ ID NO: 28 encoding an Inactive protein of the TRPV channel, wherein the first and the second expression vectors further include an adenovirus core origin, a third nucleic acid encoding a fluorescent protein, nucleic acids encoding epitope tags, and a regulatable promoter system. The regulatable promoter system includes a Tet repressor binding site and a minimal cytomegalovirus promoter operably linked to the TRPV channel coding region. The first and the second expression vectors are optimized for mammalian expression.

In yet another embodiment, the present invention relates to an expression vector that includes a first nucleic acid molecule encoding a Nanchung protein and a second nucleic acid molecule encoding an Inactive protein. Preferably, upon the expression in a cell an insect TRPV channel is formed. The expression vector may further include a regulatable promoter system. The regulatable promoter system may include at least one Tet repressor binding site. The regulatable promoter may be a minimal cytomegalovirus promoter operably linked to the nucleic acid molecule encoding an insect TRPV channel. The promoter system may be regulatable by tetracycline or doxycycline. The vector may include an adenovirus core origin.

In another embodiment, the present invention relates to an expression vector that includes an adenovirus core origin; a transient receptor potential V (TRPV) channel coding region that includes a first nucleic acid encoding a Nanchung protein of the TRPV channel and a second nucleic acid encoding an Inactive protein of the TRPV channel; a third nucleic acid encoding a fluorescent protein flanked by two nucleic acids encoding epitope tags; and a regulatable promoter system that includes a Tet repressor binding site and a minimal cytomegalovirus promoter operably linked to the TRPV channel coding region. Preferably, the entire coding region is codon-optimized for mammalian expression. Alternatively, the coding region may be non-optimized for mammalian expression.

In yet another embodiment, the present invention relates to a cell that includes the expression vector described herein. The Nanchung protein and the Inactive protein may be co-expressed in the cell line. The cell line may be of insect, mouse, hamster, human cell, or any cell line that normally do not express Nanchung or Inactive proteins. Preferably, the cell line co-expresses the Nanchung and Inactive proteins at a ratio of about 3:1 to about 1:3, more preferably about 1:1.

BRIEF DESCRIPTION OF THE DRAWINGS

FIGS. 2B-D depict activation of $Ca^{2+}$ mobilization by pyrifluquinazon and its N-deacetylated form, Metabolite B in CHO cells expressing: (B) Nanchung (Nan) alone; (C) Inactive (Iav) protein alone; or (D) co-expressing Nan and Iav protein.

FIG. 4A depicts a graph demonstrating that activation of insect TRPV channel by Metabolite B of pyrifluquinazon requires presence of $Ca^{2+}$ in the extracellular media.

FIG. 4B depicts a graph demonstrating inhibition of the response by ion channel blocker, ruthenium red.

FIG. 4C depicts a graph showing response of insect TRPV-expressing cells to Metabolite B measured using $Ca^{2+}$ probe, FLUO4 or plasma membrane potential probe (arrow indicates injection of the Metabolite B).

FIG. 4D depicts a graph showing dose response of insect TRPV channel-expressing cells stimulated by Metabolite B and measured using $Ca^{2+}$ probe, FLUO4 or plasma membrane potential probe.

FIGS. 6-32 correspond to SEQ ID NOS: 1-27, respectively, and provide the nucleotide sequence of a Nanchung (Nan) gene having the accession number specified in the Figure.

FIGS. 33-59 correspond to SEQ ID NOS: 54-80, respectively, and provide the amino acid sequence of a Nan protein having the accession number specified in the Figure.

FIGS. 60-85 correspond to SEQ ID NOS: 28-53, respectively, and provide the nucleotide sequence of an Inactive (Iav) gene having the accession number specified in the Figure.

FIGS. 86-111 correspond to SEQ ID NOS: 81-106, respectively, and provide the amino acid sequence of an Iav protein having the accession number specified in the Figure.

FIG. 112 depicts a sequence alignment of the Nan proteins (SEQ ID NOS 59, 60, 63, 58, 57, 56, 54, 74, 73, 75, 66, 70, 110, 68, and 111, residues 1-448 and 560-900 of SEQ ID NO: 64, and SEQ ID NOS 76, 79, 62, 77, 72, 78, 71, 80, 65, and 61, all respectively, in order of appearance).

FIG. 113 depicts sequence alignment of the Iav proteins (SEQ ID NOS 84 and 85, residues 1-916, 954-1102, and 1167-1216 of SEQ ID NO: 86, and SEQ ID NOS 83, 82, 81, 101, 104, 100, 99, 92, 98, 93, 90, 89, 94, 95, 88, 102, 112, 103, 105, 106, 96, 87, and 91, all respectively, in order of appearance).

DETAILED DESCRIPTION OF THE DRAWINGS AND THE PRESENTLY PREFERRED EMBODIMENTS

I. General Considerations

Figure 1:
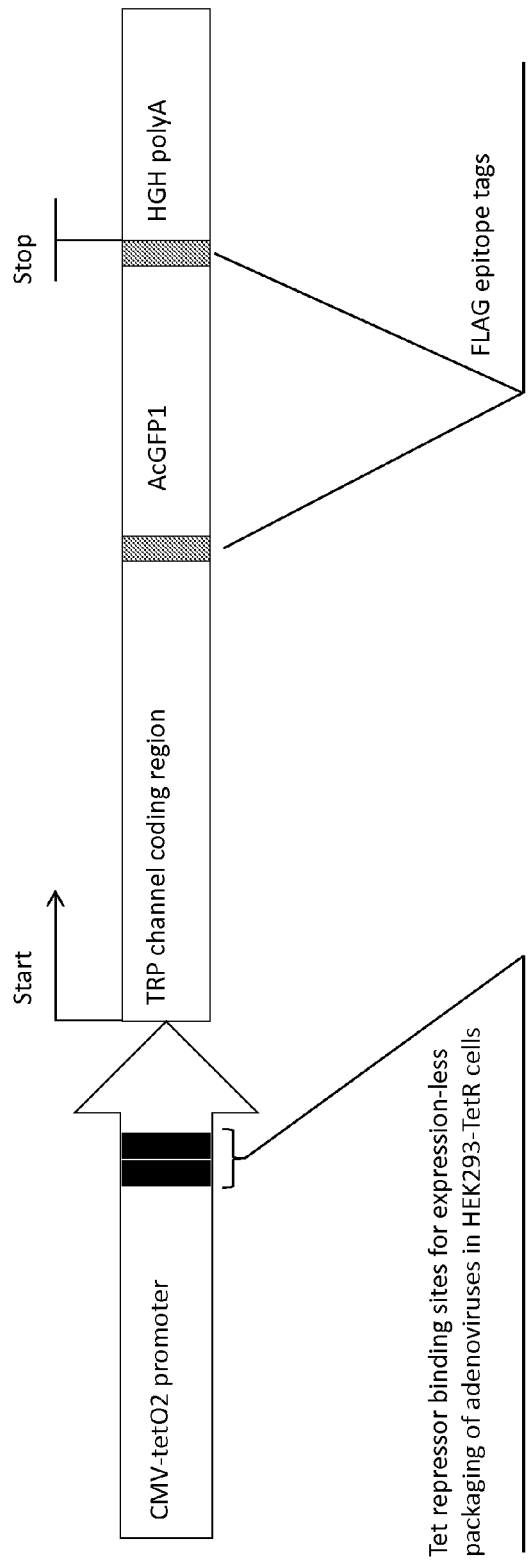
FIG. 1 depicts a schematic illustration of the expression cassette for insect and mammalian TRP channels in an adenovirus shuttle vector.

The transient receptor potential (TRP) channels constitute a large and important class of channels involved in modulating cellular homeostasis. The present invention provides methods and compositions that modulate at least one TRP family member, namely a TRPV channel in an insect.

Specifically, the present invention provides methods and compositions for modulating an insect TRPV channel. Modulating an insect TRPV channel may modulate calcium homeostasis, sodium homeostasis, intracellular calcium levels, membrane polarization (resting membrane potential), and/or cation levels in a cell. Compounds that can modulate one or more insect TRPV channels are useful in many aspects including, but not limited to, insect control.

Without being bound by theory, the modulation of an insect TRPV elicits a signaling pathway that brings forth motor neuron modulation which may increase or decrease feeding behavior of an insect, and such modulation (e.g., activation) of an insect TRPV channel in an insect may lead to a decrease in feeding behavior of such insect leading to the insect's death by starvation. Thus, again without being bound by theory, it is believed that compounds that modulate (e.g., activate) an insect TRPV channel may be used as insecticides.

TRP channels have been classified into at least six groups: TRPC (short), TRPV (vanilloid), TRPM (long, melastatin), TRPP (polycystins), TRPML (mucolipins), and TRPA (ANKTM1).

The TRPC group can be divided into 4 subfamilies (TRPC1, TRPC4,5, TRPC3,6,7 and TRPC2) based on sequence homology and functional similarities.

Currently, the mammalian TRPV family has 6 members. TRPV5 and TRPV6 are more closely related to each other than to TRPV1, TRPV2, TRPV3, or TRPV4. TRPA1 is most closely related to TRPV3, and is more closely related to TRPV1 and TRPV2 than to TRPV5 and TRPV6. The TRPV is expressed in a great number of organisms, including, e.g., insects (*Drosophila, Tribolium, Pediculus, Culex,* and *Anopheles*) and mammals (humans, mice, rats, monkeys and chimpanzee).

Insects TRPV channels are represented by Nanchung and Inactive proteins, which are presumed to form a complex, with unknown stoichiometry, which are implicated in insect hearing (Matsuura et al., 2009).

The TRPM family has 8 members. Constituents include the following: the founding member TRPM1 (Melastatin or LTRPC1), TRPM3 (KIAA1616 or LTRPC3), TRPM7 (TRPPLIK, ChaK(1), LTRPC7), TRPM6 (ChaK2), TRPM2 (TRPC7 or LTRPC2), TRPM8 (Trp-p8 or CMR1), TRPM5 (Mtr1 or LTRPC5), and TRPM4 (FLJ20041 or LTRPC4).

The sole mammalian member of the TRPA family is ANKTM1.

The TRPML family consists of the mucolipins, which include TRPML1 (mucolipins 1), TRPML2 (mucolipins 2), and TRPML3 (mucolipin3).

The TRPP family consists of two groups of channels: those predicted to have six transmembrane domains and those that have 11. TRPP2 (PKD2), TRPP3 (PKD2L1), TRPP5 (PKD2L2) are all predicted to have six transmembrane domains. TRPP1 (PKD1, PC1), PKD-REJ and PKD-1L1 are all thought to have 11 transmembrane domains.

The inventors have discovered that TRPV exhibits species specific differences in response to different chemical compounds and its modulation may lead to identification of suitable chemical compounds that can function as insecticides.

II. Definitions

Unless defined otherwise, all technical and scientific terms used herein have the same meaning as commonly understood to one of ordinary skill in the art. Although any methods, devices, and materials similar or equivalent to those described herein can be used in the practice or testing of the presently disclosed subject matter, representative methods, devices, and materials are now described.

The terms "a," "an," and "the" refer to "one or more" when used in this application, including the claims. Thus, for example, reference to "a cell" (e.g., "a mammalian cell") includes a plurality of such cells (e.g., a plurality of mammalian cells in culture).

As used herein, the term "about," when referring to a value or to an amount of mass, weight, time, volume, concentration or percentage is meant to encompass variations of in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed method.

The terms "insect," "insect pest," or "plant insect pest" refer to any one of the numerous usually small arthropod animals of the class Insecta that is known to associate with plants and which, as a result of that association, causes a detrimental effect on the plant's health and vigor. The term plant as used herein encompasses whole plants and parts of plants such as roots, stems, leaves and seed, as well as cells and tissues within the plants or plant parts. The terms "insect," "insect pest," or "plant insect pest" are used interchangeably throughout the instant application.

The term "nucleic acid" refers to deoxyribonucleotides or ribonucleotides and polymers thereof in either single- or double-stranded form, composed of monomers (nucleotides) containing a sugar, phosphate and a base that is either a purine or pyrimidine. Unless specifically limited, the term encompasses nucleic acids containing known analogs of natural nucleotides, conservatively modified variants thereof, complementary sequences, and degenerate codon substitutions that have similar binding properties as the reference nucleic acid and are metabolized in a manner similar to naturally occurring nucleotides.

The terms "nucleic acid" or "nucleic acid molecule" can also be used interchangeably with gene, open reading frame (ORF), cDNA, and mRNA encoded by a gene, nucleic acid molecule, nucleic acid fragment, nucleic acid segment, or polynucleotide.

The term "gene" is used broadly to refer to any segment of nucleic acid associated with a biological function. Thus, genes include coding sequences and/or the regulatory sequences required for their expression. For example, "gene" refers to a nucleic acid fragment that expresses mRNA, functional RNA, or specific protein, including regulatory sequences. "Genes" also include non-expressed DNA segments that, for example, form recognition sequences for other proteins. "Genes" can be obtained from a variety of sources, including cloning from a source of interest or synthesizing from known or predicted sequence information, and may include sequences designed to have desired parameters.

The term "gene delivery" or "gene transfer" refers to methods or systems for reliably inserting foreign DNA into target cells and include transduction, transfection and transformation. Such methods can result in transient or long term expression of genes.

The term "transduction" refers to the delivery of a DNA molecule to a recipient cell either in vivo or in vitro, via a replication-defective viral vector, such as, e.g., adenoviral vector.

The term "transfection" is used to refer to the uptake of foreign DNA by a mammalian cell. A cell has been "transfected" when exogenous DNA has been introduced across the cell plasma membrane. Transfection can be used to introduce one or more exogenous DNA moieties, such as a plasmid vector and other nucleic acid molecules, into suitable cells. The term refers to both stable and transient uptake of the genetic material.

The term "transformation" refers to a process for introducing heterologous DNA into a cell. Transformed cells are understood to encompass not only the end product of a transformation process, but also transgenic progeny thereof.

The term "vector" refers to any genetic element, such as a plasmid, phage, transposon, cosmid, chromosome, virus, virion, etc., which is capable of replication when associated with the proper control elements, such as a helper virus, and which can transfer gene sequences between cells. Thus, the term includes cloning and expression vehicles, as well as replication-defective viral vectors.

The terms "expression vector" and "expression cassette" refer to a nucleic acid molecule capable of directing expression of a particular nucleotide sequence in an appropriate host cell, typically comprising a promoter operatively linked to the nucleotide sequence of interest which is operatively linked to termination signals. It also typically comprises sequences required for proper translation of the nucleotide sequence. The coding region usually encodes a polypeptide(s) of interest but can also encode a functional RNA of interest, for example antisense RNA or a non-translated RNA, in the sense or antisense direction. The expression cassette comprising the nucleotide sequence of interest can be chimeric, meaning that at least one of its components is heterologous with respect to at least one of its other components. The expression cassette can also be one that is naturally occurring but has been obtained in a recombinant form useful for heterologous expression. Typically, however, the expression cassette is heterologous with respect to the host; i.e., the particular DNA sequence of the expression cassette does not occur naturally in the host cell and was introduced into the host cell or an ancestor of the host cell by a transformation event. The expression of the nucleotide sequence in the expression cassette can be under the control of a constitutive promoter or of an inducible promoter that initiates transcription only when the host cell is exposed to some particular external stimulus. In the case of a multicellular organism such as a plant, the promoter can also be specific to a particular tissue, organ, or stage of development.

The term "adenovirus" refers to a vector derived from an adenovirus serotype. Adenoviruses are double-stranded DNA viruses capable of infecting broad range of mammalian cells, both dividing and non-dividing. The adenovirus DNA is linear of approximately 36,000 bp. The most widely used adenoviral vectors for gene delivery are the replication-deficient vectors, in which the E1 and E3 regions of the adenoviral genome are deleted. E1-deleted viruses are propagated in complementing cells, such as HEK-293, which provide E1-encoded proteins in trans. E1/E3-deleted adenoviruses can accommodate up to 7.5 kb of foreign DNA. The classical method of incorporating foreign DNA into adenovirus genome involves homologous recombination in mammalian cells. More efficient method, as described in the present examples involves homologous recombination in *Escherichia coli* between a large plasmid containing most of the adenovirus genome and a small shuttle plasmid. The shuttle plasmid contains the expression cassette flanked by sequences homologous to the region to be targeted in the viral genome. The recombinant Ad genome is then linearized by restriction digestion and used to transfect E1-complementing mammalian cells to produce viral particles (Douglas J T., Methods Mol Biol. 2004; V246:3-14) To produce adenoviruses containing toxic gene, special adenoviral vectors have been developed where expression of foreign gene is suppressed during virus production. One of these systems, named, SpeAd Ad-teto system is offered by, for example, Welgen, Inc.

The term "tetracycline-controlled transactivator" (tTA) refers to a fusion protein used to control nucleic acid expression in the presence or absence of doxyclycline, tetracycline and related compounds. The tTA includes a Tet repressor (TetR) fused to any domain capable of activating transcription. The tTA may include a TetR fused to a C-terminal portion of adenovirus.

The term "operably linked" refers to two nucleic acid sequences that are related physically or functionally. For example, a promoter or regulatory DNA sequence is said to be "operably linked to" a DNA sequence that encodes an RNA or a polypeptide if the two sequences are situated such that the regulatory DNA sequence will affect the expression level of the coding or structural DNA sequence. A promoter is also said to be operably linked to a nucleotide sequence if when an RNA polymerase binds to the promoter under conditions sufficient for transcription, the nucleotide sequence is transcribed.

The term "isolated," when applied to a nucleic acid or polypeptide, denotes that the nucleic acid or polypeptide is essentially free of other cellular components with which it is associated in the natural state. It can be in a homogeneous state although it can be in either a dry or aqueous solution. Homogeneity and whether a molecule is isolated can be determined using analytical chemistry techniques such as polyacrylamide gel electrophoresis or high performance liquid chromatography. A polypeptide that is the predominant species present in a preparation is substantially isolated.

The term "isolated" denotes that a nucleic acid or polypeptide gives rise to essentially one band in an electrophoretic gel. Particularly, it means that the nucleic acid or polypeptide is in some embodiments at least about 50% pure, in some embodiments at least about 85% pure, and in some embodiments at least about 99% pure.

The terms "label" and "labeled" refer to the attachment of a moiety, capable of detection by spectroscopic, radiologic, or other methods, to a molecule. Thus, the terms "label" or "labeled" refer to incorporation or attachment, optionally covalently or non-covalently, of a detectable marker into a molecule, such as a biomolecule. Various methods of labeling biomolecules are known in the art and can be used. Examples of labels for biomolecules include, but are not limited to, the following: radioisotopes, fluorescent labels, heavy atoms, enzymatic labels or reporter genes, chemiluminescent groups, and biotinyl groups. In some embodiments, labels are attached by spacer arms of various lengths to reduce potential steric hindrance. Fluorescent probe that can be utilized include, but are not limited to fluorescein isothiocyanate; fluorescein dichlorotriazine and fluorinated analogs of fluorescein; naphthofluorescein carboxylic acid and its succinimidyl ester; carboxyrhodamine 6G; pyridyloxazole derivatives; Cy2, 3, 3.5, 5, 5.5, and 7; phycoerythrin; phycoerythrin-Cy conjugates; fluorescent species of succinimidyl esters, carboxylic acids, isothiocyanates, sulfonyl chlorides, and dansyl chlorides, including propionic acid succinimidyl esters, and pentanoic acid succinimidyl esters; succinimidyl esters of carboxytetramethylrhodamine; rhodamine Red-X succinimidyl ester; Texas Red sulfonyl chloride; Texas Red-X succinimidyl ester; Texas Red-X sodium tetrafluorophenol ester; Red-X; Texas Red dyes; tetramethylrhodamine; lissamine rhodamine B; tetramethylrhodamine; tetramethylrhodamine isothiocyanate; naphthofluoresceins; coumarin derivatives (e.g., hydroxycoumarin, aminocoumarin, and methoxycoumarin); pyrenes; pyridyloxazole derivatives; dapoxyl dyes; Cascade Blue and Yellow dyes; benzofuran isothiocyanates; sodium tetrafluorophenols; 4,4-difluoro-4-bora-3a,4a-diaza-s-indacene; Alexa fluors (e.g., 350, 430, 488, 532, 546, 555, 568, 594, 633, 647, 660, 680, 700, and 750); green fluorescent protein; and yellow fluorescent protein. The peak excitation and emission wavelengths will vary for these compounds and selection of a particular fluorescent probe for a particular application can be made in part based on excitation and/or emission wavelengths.

As used herein, the terms "candidate compound" or "test compound" refer to the collection of compounds that are to be screened for their ability to modulate insect TRPV channels and may be used interchangeably. The candidate compounds may encompass numerous classes of chemical molecules, e.g., small organic or inorganic molecules, polysaccharides, biological macromolecules, e.g., peptides, proteins, peptide analogs and derivatives, peptidomimetics, nucleic acids, nucleic acid analogs and derivatives, an extract made from biological materials such as bacteria, plants, fungi, or animal cells or tissues, naturally occurring or synthetic compositions, or combinations thereof. Generally, the candidate compounds can have a molecular weight of about 50 to 500,000, but is not limited thereto.

As used herein, the term "small molecule" refers to a compound that is "natural product-like," however, the term "small molecule" is not limited to a "natural product-like" compound. Rather, a small molecule is typically characterized in that it contains several carbon-carbon bonds, and has a molecular weight more than about 50, but less than about 5000 Daltons (5 kD). Preferably the small molecule has a molecular weight of less than than 3 kD, still more preferably less than 2 kD, and most preferably less than 1 kD. In some cases it is preferred that a small molecule have a molecular mass equal to or less than 700 Daltons.

In some embodiments, the candidate compound may be a synthetic molecule. The term "synthetic molecule" refers to a molecule that does not occur in nature.

In certain embodiments, the candidate compound may be a naturally-occurring molecule. Such a naturally-occurring molecule may be used in a purified or unpurified form, i.e., as obtained from the biological source. The term "naturally occurring" refers to an entity (e.g., a cell, biomolecule, etc.) that is found in nature as distinct from being artificially produced by man. For example, a polypeptide or nucleotide sequence that is present in an organism in its natural state, which has not been intentionally modified or isolated by man in the laboratory, is naturally occurring. As such, a polypeptide or nucleotide sequence is considered "non-naturally occurring" if it is encoded by or present within a recombinant molecule, even if the amino acid or nucleic acid sequence is identical to an amino acid or nucleic acid sequence found in nature.

Depending upon the particular embodiment being practiced, the candidate compounds may be provided free in solution, or may be attached to a carrier, or a solid support, e.g., beads. A number of suitable solid supports may be employed for immobilization of the candidate compounds. Examples of suitable solid supports include agarose, cellulose, dextran (commercially available as, i.e., Sephadex, Sepharose) carboxymethyl cellulose, polystyrene, polyethylene glycol (PEG), filter paper, nitrocellulose, ion exchange resins, plastic films, polyaminemethylvinylether maleic acid copolymer, glass beads, amino acid copolymer, ethylene-maleic acid copolymer, nylon, silk, etc. Additionally, for the methods described herein, the candidate compounds may be screened individually, or in groups. Group screening is particularly useful where hit rates for effective candidate compounds are expected to be low such that one would not expect more than one positive result for a given group.

There are millions of possible candidate compounds. Methods for developing small molecule, polymeric and genome based libraries are known and described, for example, in Ding, et al. J. Am. Chem. Soc. 124: 1594-1596 (2002) and Lynn, et al., J. Am. Chem. Soc. 123: 8155-8156 (2001). A number of small molecule libraries are known in the art and commercially available. Commercially available compound libraries can be obtained from, e.g., ArQule, Pharmacopia, graffinity, Panvera, Vitas-M Lab, Biomol International and Oxford. These libraries can be screened using the screening methods described herein. Chemical compound libraries such as those from of 10,000 compounds and 86,000 compounds from NIH Roadmap, Molecular Libraries Screening Centers Network (MLSCN) can also be used. A comprehensive list of compound libraries can be found at www.broad.harvard.edu/chembio/platform/screening/compound_libraries/index.htm. A chemical library or compound library is a collection of stored chemicals usually used ultimately in high-throughput screening or industrial manufacture. The chemical library can consist in simple terms of a series of stored chemicals. Each chemical has associated information stored in some kind of database with information such as the chemical structure, purity, quantity, and physiochemical characteristics of the compound.

The term "modulate" refers to an increase, decrease, or other alteration of any, or all, chemical and/or biological activities and/or properties of a biomolecule, such as the TRPV (e.g., insect TRPV) channel of the present invention. The term "modulation" as used herein thus refers to both upregulation (i.e., activation or stimulation) and downregulation (i.e., inhibition or suppression) of such an activity or property. As would be understood by one of ordinary skill in the art, a modulation of a chemical and/or biological activity and/or property of a biomolecule, such as TRPV channel, can result from an increase or decrease in the expression of the biomolecule in a cell. Accordingly, the terms "modulate" and grammatical variants thereof are intended to encompass both direct modulation (e.g., inhibition of a chemical and/or biological activity and/or property of a polypeptide via binding of an inhibitor to the polypeptide) as well as indirect modulation (e.g., upregulation or downregulation of expression of a protein, such as a TRPV channel or inhibition or stimulation of a biomolecule that acts together with a biomolecule of the presently disclosed subject matter to produce a biological effect).

The terms "polypeptide," "protein," and "peptide," which are used interchangeably herein, refer to a polymer of the 20 protein amino acids, or amino acid analogs, regardless of its size or function. Although "protein" is often used in reference to relatively large polypeptides, and "peptide" is often used in reference to small polypeptides, usage of these terms in the art overlaps and varies. The term "polypeptide" as used herein refers to peptides, polypeptides, and proteins, unless otherwise noted. The terms "protein," "polypeptide," and "peptide" are used interchangeably herein when referring to a gene product. Thus, exemplary polypeptides include gene products, naturally occurring proteins, homologs, orthologs, paralogs, fragments and other equivalents, variants, and analogs of the foregoing.

III. Screening Methods

The inventors have discovered that insect TRPV channels may be used to identify compounds that block insect feeding behavior and thus be useful as insecticides. As such, in one embodiment, the present invention relates to a method for determining whether or not a candidate compound is a modulator of an insect TRPV channel. The method includes providing a first cell expressing an insect TRPV channel; contacting the first cell with a candidate compound; and assaying for modulation of the insect TRPV channel, wherein the modulation of the insect TRPV channel identifies the candidate compound as a modulator of the insect TRPV channel. Modulation of the TRPV channel may be assayed using conventional in vitro and in vivo methods well known to the skilled artisan. For example, in certain embodiments, the assaying step may include (1) detecting calcium ion mobilization in the first cell in response to the candidate compound, (2) detecting a membrane potential in the first cell in response to the candidate compound, (3) comparing calcium ion mobilization in the first cell in the absence of the candidate compound with calcium ion mobilization in the first cell in the presence of the candidate compound, (4) comparing a membrane potential in the first cell in the absence of the candidate compound with a membrane potential in the first cell in the presence of the candidate compound, (5) comparing calcium ion mobilization in the first cell in the presence of the candidate compound with calcium ion mobilization reference level indicative of no modulation of the TPRV channel, and/or (6) comparing a membrane potential in the first cell in the presence of the candidate compound with a membrane potential reference level indicative of no modulation of the TPRV channel. For example, calcium flux may be measured by assessment of the uptake of $Ca^{2+}$ or by using fluorescent dyes, such as Fura-2 or fluorescent proteins, such as GFP.

Preferably, the candidate compound may modulate the calcium ion mobilization or the membrane potential in the first cell by at least 10% relative to the reference level; more preferably at least 20% relative to the reference level; more preferably at least 30% relative to the reference level; more preferably at least 40% relative to the reference level; more preferably at least 50% relative to the reference level; more preferably at least 60% relative to the reference level; more preferably at least 70% relative to the reference level; more preferably at least 75% relative to the reference level; more preferably at least 80% relative to the reference level; more preferably at least 85% relative to the reference level; more preferably at least 90% relative to the reference level; and more preferably at least 95% relative to the reference level.

In addition, activation of TRPV channel may be assayed using a variety of other conventional assays that measure changes in ion fluxes including, but not limited to, patch clamp techniques, measurement of whole cell currents, radiolabeled ion flux assays, and fluorescence assays using volt-age sensitive dyes (Zheng at al., 2004).

Modulation of an insect TRPV channel may also be assessed using a variety of other in vitro and in vivo assays to determine functional, chemical, and physical effects, e.g., measuring the binding of the insect TRPV to other molecules, including peptides, small organic molecules, and lipids; measuring insect TRPV protein and/or mRNA levels, or measuring other aspects of insect TRPV polypeptides, e.g., transcription levels, or physiological changes.

As noted previously, the candidate compound may be a small organic molecule, small inorganic molecule, polysaccharides, peptides, proteins, nucleic acids, an extract made from biological materials such as bacteria, plants, fungi, animal cells, animal tissues, and any combination thereof.

Generally, a candidate compound can be tested at any concentration that can modulate the activity of insect TRPV channel over a suitable time period. In some embodiments, the candidate compound may be tested at a concentration in the range of about 0.1 nM to about 1000 mM. In certain other embodiments, the compound may be tested in the range of about 100 μM to about 1000 μM. In certain further embodiments, the candidate compound may be tested at 0.05 mM, 0.1 mM, 0.2 mM, 0.3 mM, 0.4 mM, 0.5 mM, 0.6 mM, 0.7 mM, 0.8 mM, 0.9 mM, 1 mM, 1.1 mM, 1.2 mM, 1.3 mM, 1.4 mM, 1.5 mM, 1.6 mM, 1.7 mM, 1.8 mM, 1.0 mM, or 2 mM. Other ranges and concentrations of the candidate compound may also be suitable.

In some embodiments, the candidate compound may be tested at two or more different concentrations. Preferably the highest concentration tested is at least 2×, at least 3×, at least 4×, at least 5×, at least 6×, at least 7×, at least 8×, at least 9×, at least 10×, at least 15×, at least 20×, at least 25×, at least 50×, at least 75×, at least 100×, at least 200×, at least 250× higher than the lowest concentration employed. For example, the candidate compound may be tested at 0.1 mM, 0.5 mM, and 1 mM.

Generally, the insect TRPV channel may be contacted with a candidate compound for any suitable length of time before measuring and activity of the insect TRPV channel. For example, the insect TRPV channel may be contacted with a candidate compound for at least 5 seconds, at least 10 seconds, at least 15 seconds, at least 30 seconds, at least 45 seconds, at least 1 minute, at least 2 minutes, at least 3 minutes, at least 4 minutes, at least 5 minutes, at least 10 minutes, at least 15 minutes, at least 30 minutes, at least 60 minutes, or more before activity of the insect TRPV is measured. In some embodiments, activity may be measured at the instant when the insect TRPV is contacted with a candidate compound.

In some embodiments, activity of insect TRPV channel may be measured over a period of time. For example, activity may be measured for a period of at least 5 seconds, at least 10 seconds, at least 15 seconds, at least 30 seconds, at least 45 seconds, at least 1 minute, at least 2 minutes, at least 3 minutes, at least 4 minutes, at least 5 minutes, at least 10 minutes, at least 15 minutes, at least 30 minutes, at least 60 minutes, or more. The measurement period can start before the insect TPRV channel is contacted with a candidate compound, at the instant when the insect TRPV is first contacted with a candidate compound or start after a period of time after the insect TRPV is first contacted with a candidate compound. The insect TRPV may be continuously contacted with the candidate compound while activity is measured.

In some embodiments, the candidate compound has an EC50 of less than or equal to 500 nM, less than or equal to 250 nM, less than or equal to 100 nM, less than or equal to 50 nM, less than or equal to 10 nM, less than or equal to 1 nM, less than or equal to 0.1 nM, less than or equal to 0.01 nM, or less than or equal to 0.001 nM for activating an insect-specific TRPV channel.

In some embodiments, the candidate compound has an IC50 of less than or equal to 500 nM, less than or equal to 250 nM, less than or equal to 100 nM, less than or equal to 50 nM, less than or equal to 10 nM, less than or equal to 1 nM, less than or equal to 0.1 nM, less than or equal to 0.01 nM, or less than or equal to 0.001 nM for inhibiting an insect-specific TRPV channel.

In certain embodiments, the candidate compound is a modulator that inhibits the activity of the insect TRPV channel.

In certain other embodiments, the candidate compound is a modulator that activates the insect TRPV channel.

Preferably, the candidate compound is a modulator that inhibits an insect feeding behavior.

In certain embodiments, to determine whether a candidate compound preferentially modulates the insect-specific TRPV channel relative to a mammalian-specific TRPV channel, the method may further include providing a second cell expressing a mammalian TRPV channel. The second cell may be contacted with the candidate compound and modulation of mammalian TRPV channel may be assayed by the methods known in the art, which were also described above. Following the assaying steps the modulation of the insect TRPV channel may be compared with the modulation of the mammalian TRPV channel and the candidate compound that displays an increased modulation of the insect-specific TRPV channel relative to the mammalian TRP channel identifies the candidate compound as a selective modulator of the insect TRPV channel.

By the term "preferential modulation" is meant that activity or other property of insect-specific TRPV is modulated by at least 5%, at least 10%, at least 20%, at least 30%, at least 40%, at least 50%, at least 60%, at least 70%, at least 80%, at least 90%, at least 95%, at least 100%, or more relative to a reference level or the mammalian-specific TRPV channel.

In certain other embodiments, non-selective modulators of the TRPV channel may be identified. The term "non-selective" in connection with a modulator of the TRPV channel means that a compound can modulate a TRPV or TRP channel in different organisms, e.g., a compound may modulate both, insect and mammalian TRPV channels.

In certain other embodiments, the candidate compound is an insect-specific TRP channel modulator and does not modulate the activity of the mammalian-specific TRP, e.g., the tested compound has no significant effect on the mammalian-specific TRPV channel.

In certain embodiments, the insect TRPV channel is in a biological cell. In some embodiments, the mammalian TRPV channel is in a biological cell. The term "biological cell" or "cell" as used herein has its commonly understood meaning. Inside a cell, the TRPV channel may be expressed from an endogenous gene in the cell or from at least one vector that is transfected into the cell. Preferably, the TRPV channel proteins, Nanchung and Inactive proteins are co-expressed in the cell. The Nanchung and Inactive proteins may be co-expressed at varying rations, preferably, the ratio of the Nanchung to Inactive proteins co-expressed in the first cell is about 3:1 to about 1:3, more preferably about 1:1.

The insect TRPV channel used in the screening assay of the present invention may be any insect TRPV channel or homolog or a conservative variant thereof. For example, the TRPV channel may be a *Drosophila* TRPV channel. Other sources of TRPV channel may also be suitable for use according to the methods of the present invention.

Insect TRPV channels are thought to be associated with Nanchung and Inactive proteins. The mammalian TRPV channel used in the screening assay may be any mammalian TRPV or homolog thereof, preferably a TRPV channel similar to an insect TRPV channel. In some embodiments, the Nanchung nucleic acid sequences may be selected from the group consisting of a) a polynucleotide molecule comprising a nucleic acid molecule having a sequence selected from the group consisting of SEQ ID NOS: 1-27 (FIGS. 6-32); b) a polynucleotide molecule having at least about 70% sequence identity to the sequence of SEQ ID NOS: 1-27 (FIGS. 6-32); and c) a fragment of the polynucleotide molecule of a) or b). Such fragments can be a UTR, a core promoter, an intron, an enhancer, a cis-element, or any other regulatory element.

In some embodiments, the Inactive nucleic acid sequences may be selected from the group consisting of a) a polynucleotide molecule comprising a nucleic acid molecule having a sequence selected from the group consisting of SEQ ID NOS: 28-53 (FIGS. 60-85); b) a polynucleotide molecule having at least about 70% sequence identity to the sequence of SEQ ID NOS: 28-53 (FIGS. 60-85); and c) a fragment of the polynucleotide molecule of a) or b). Such fragments can be a UTR, a core promoter, an intron, an enhancer, a cis-element, or any other regulatory element.

Human, mouse, rat, or hamster TRPV1, TRPV2, TRPV3, TRPV4, TRPV5 or TRPV6

The disclosed polynucleotides are capable of providing for expression of Nanchung and Inactive proteins in the host cells.

In certain embodiments, the Nanchung protein sequences may be selected from the group consisting of a) a polypeptide comprising an amino acid sequence having a sequence selected from the group consisting of SEQ ID NOS: 54-80 (FIGS. 33-59); b) a polypeptide having at least 70% sequence identity to the SEQ ID NOS: 54-80 (FIGS. 33-59); and c) a fragment or a conservative variant of the polypeptide of a) or b).

In certain embodiments, the Inactive protein sequences may be selected from the group consisting of a) a polypeptide comprising an amino acid sequence having a sequence selected from the group consisting of SEQ ID NOS: 81-106 (FIGS. 86-111); b) a polypeptide having at least 70% sequence identity to the SEQ ID NOS: 81-106 (FIGS. 86-111); and c) a fragment or a conservative variant of the polypeptide of a) or b).

Figure 112:
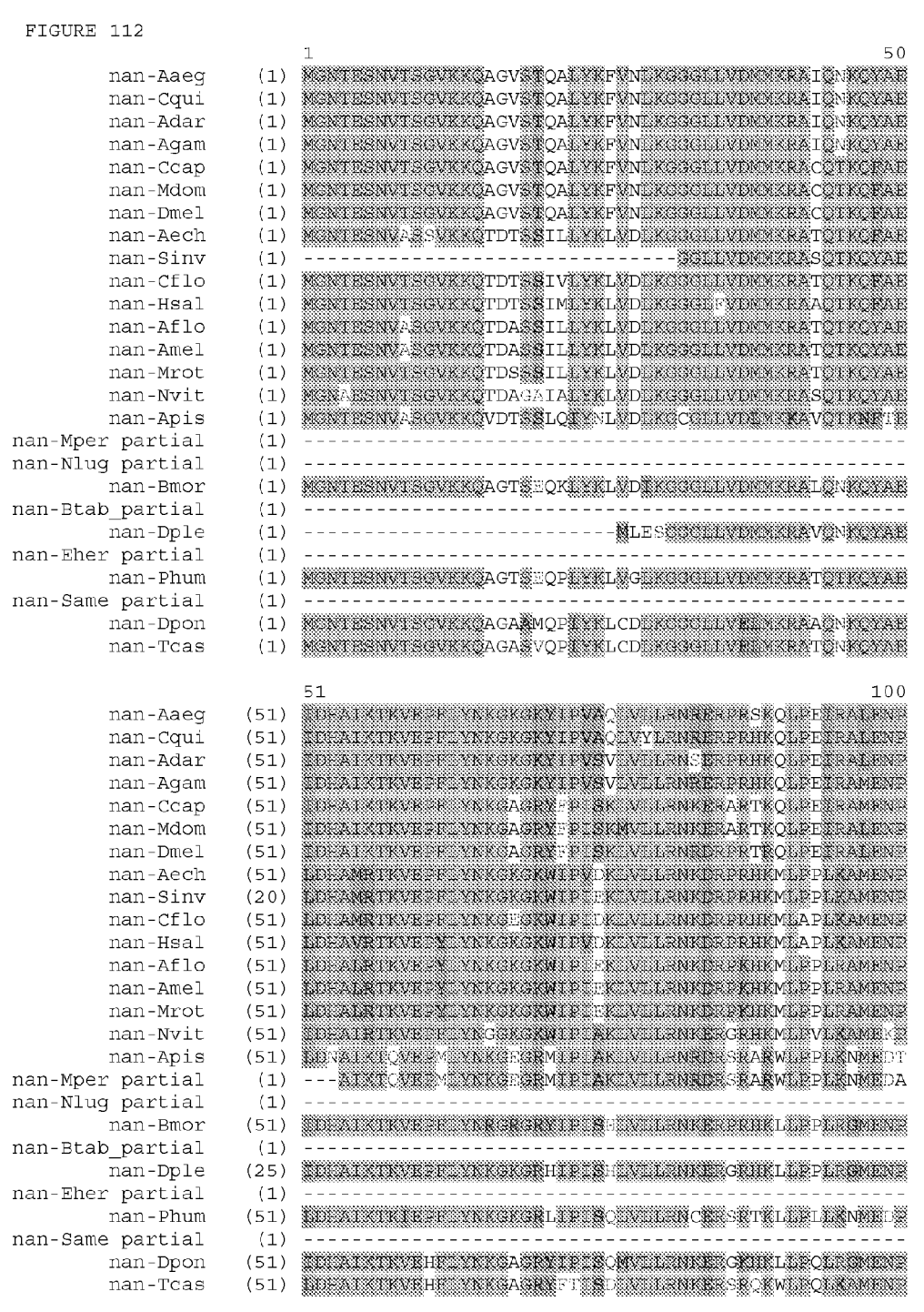
Figure 113:
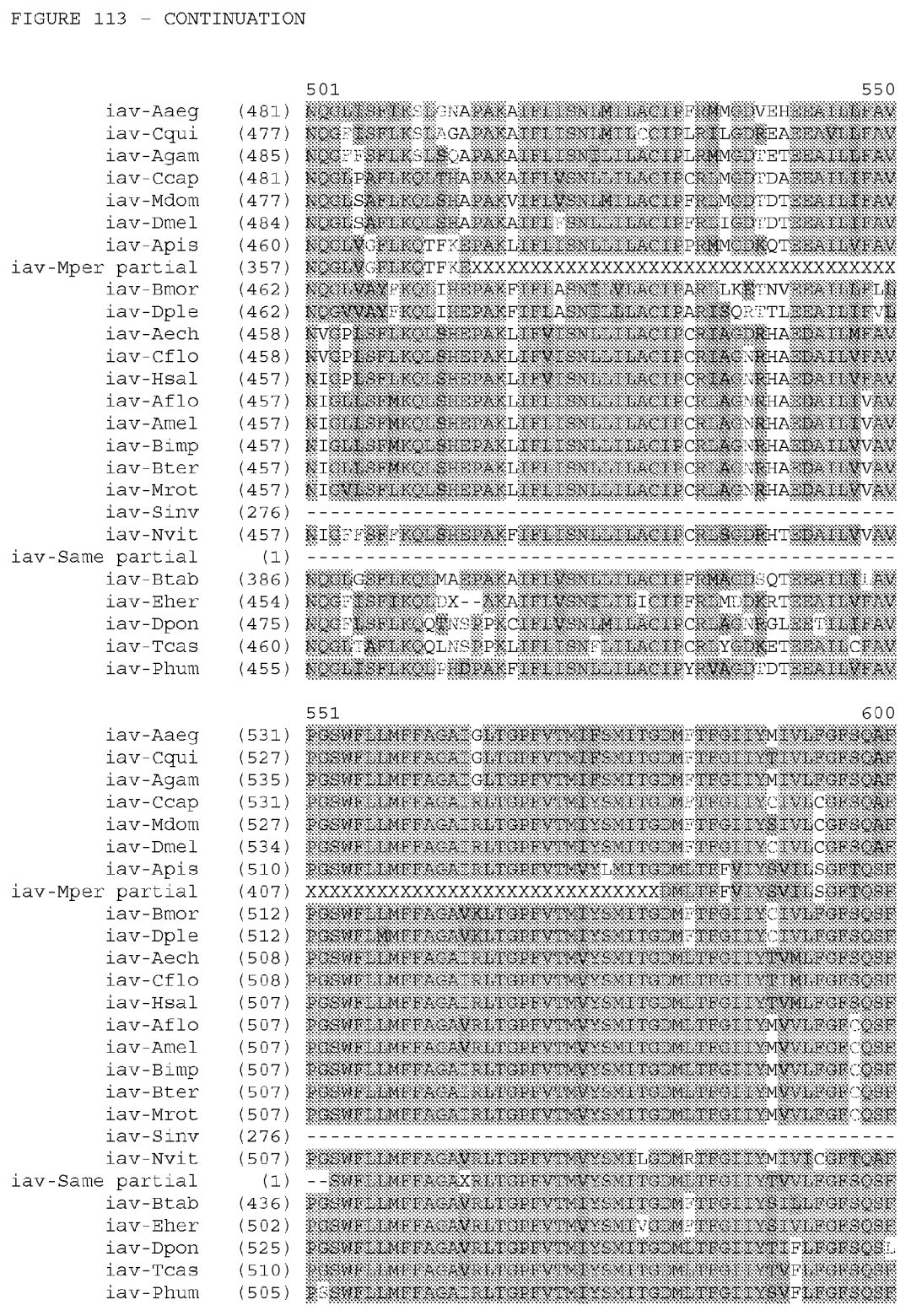
Figure 113:
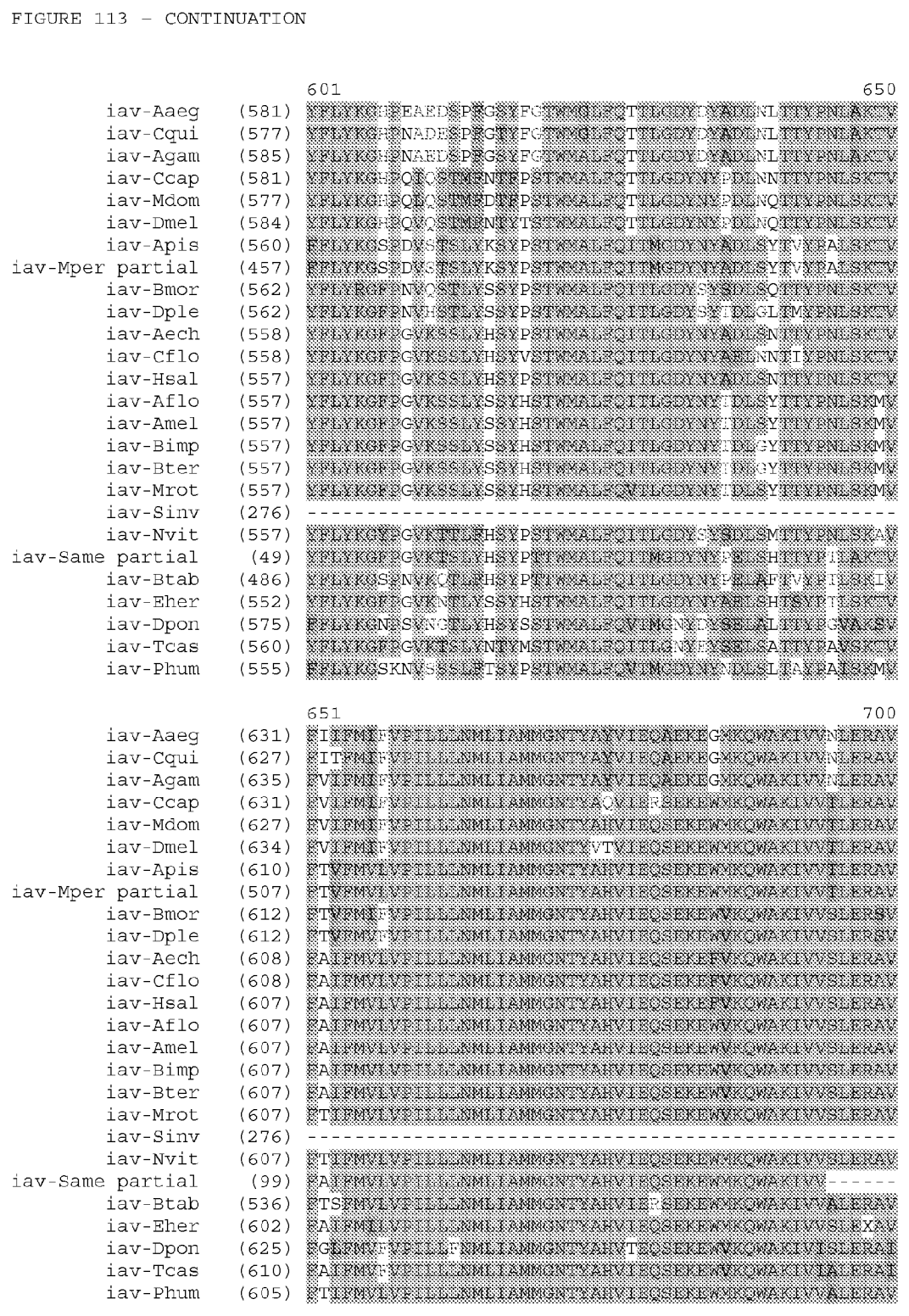
Figure 114:
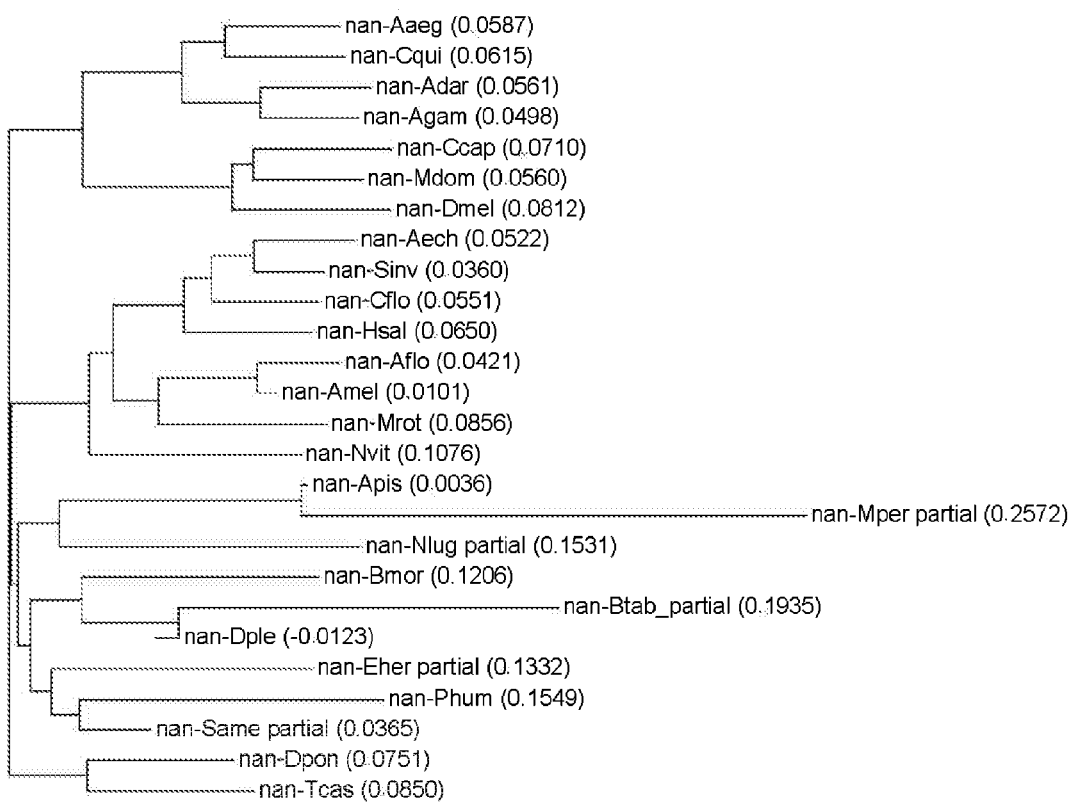
FIG. 114 depicts an alignment tree for Nan proteins.
Figure 115:
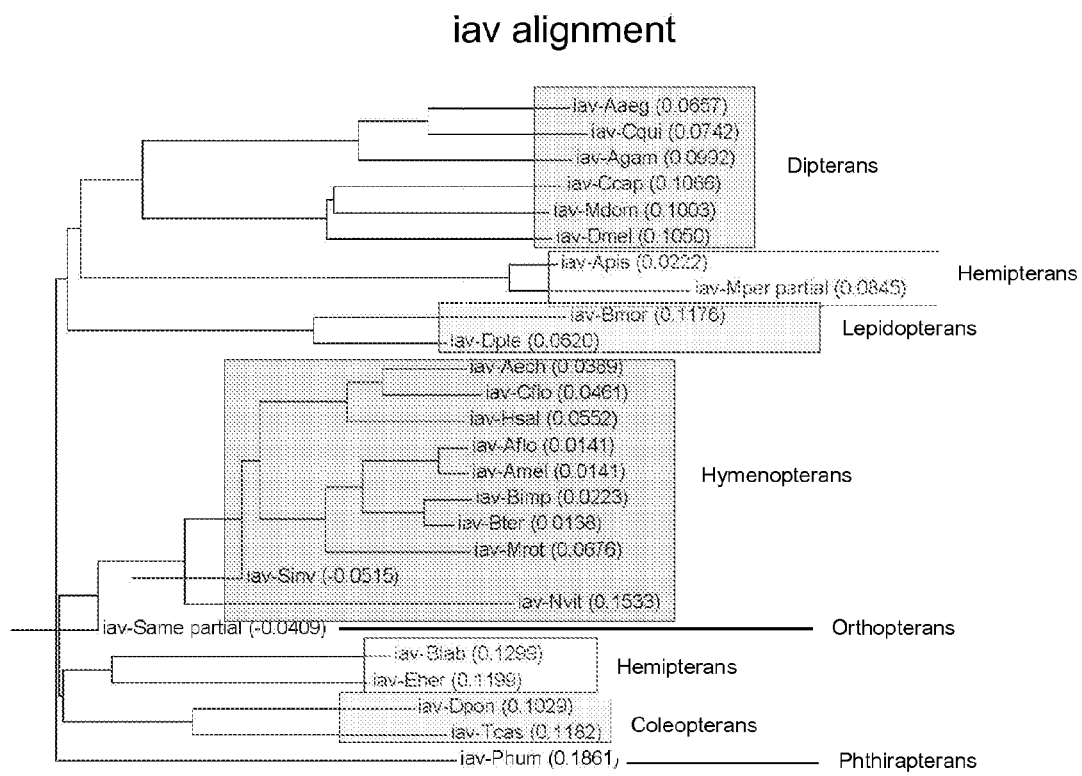
FIG. 115 depicts an alignment tree for Iav proteins.

The sequence alignment of the Nanchung and Inactive proteins is shown in FIGS. 112 and 113, respectively. The family distribution tree for the Nanchung and Inactive proteins is shown in FIGS. 114 and 115, respectively.

As used herein, the "percent sequence identity" is determined by comparing two optimally aligned sequences over a comparison window, where the portion of the polynucleotide or a polypeptide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, divided by the number of matched positions by the total number of positions in the window of comparison and multiplying the result by 100 to yield the percentage of sequence identity. Alignment for the purposes of determining the percentage identity can be achieved in various ways that are within the skill in the art, for example, using publicly available computer software such as BLAST. Those skilled in the art can determine appropriate parameters for measuring alignment, including any algorithms needed to achieve optimal alignment over the full length of the sequences being compared.

As used herein, the term a "conservative variant" refers to an amino acid sequence in which a first amino acid is replaced by a second amino acid or amino acid analog having at least one similar biochemical property, which can be, for example, similar size, charge, hydrophobicity or hydrogen bonding capacity. For example, a first hydrophobic amino acid can be conservatively substituted with a second (non-identical) hydrophobic amino acid such as alanine, valine, leucine, or isoleucine, or an analog thereof. Similarly, a first basic amino acid can be conservatively substituted with a second (non-identical) basic amino acid such as arginine or lysine, or an analog thereof. In the same way, a first acidic amino acid can be conservatively substituted with a second (non-identical) acidic amino acid such as aspartic acid or glutamic acid, or an analog thereof or an aromatic amino acid such as phenylalanine can be conservatively substituted with a second aromatic amino acid or amino acid analog, for example tyrosine. In some embodiments, the peptide comprises conservative variant substitution of at least one amino acid, e.g. 1, 2, 3, 4, 5, 6, 7, 8, 9, 10 or more amino acids. Typically, a conservative variant will retain at least 50%, 55%, 60%, 65%, 70%, 75%, 80%, 85%, 90%, 95%, 97%, 98%, 99% or more of the activity of the wild-type peptide sequence.

Exemplary conservative variant substitution include, but are not limited to, replacement of Alanine (A) with D-ala, Gly, Aib, β-Ala, Acp, L-Cys, or D-Cys; Arginine (R) with D-Arg, Lys, D-Lys, homo-Arg, D-homo-Arg, Met, Be, D-Met, or D-Ile; Asparagine (N) with D-Asn, Asp, D-Asp, Glu, D-Glu, Gln, or D-Gln; Aspartic acid (D) with D-Asp, D-Asn, Asn, Glu, D-Glu, Gln, or D-Gln; Cysteine (C) with D-Cys, S-Me-Cys, Met, D-Met, Thr, or D-Thr; Glutamine (Q) with D-Gln, Asn, D-Asn, Glu, D-Glu, Asp, or D-Asp; Glutamic Acid (E) with D-Glu, D-Asp, Asp, Asn, D-Asn, Gln, or D-Gln; Glycine (G) with Ala, D-Ala, Pro, D-Pro, Aib, β-Ala, or Acp; Isoleucine (I) with D-Ile, Val, D-Val, AdaA, AdaG, Leu, D-Leu, Met, or D-Met; Leucine (L) with D-Leu, Val, D-Val, AdaA, AdaG, Leu, D-Leu, Met, or D-Met; Lysine (K) with D-Lys, Arg, D-Arg, homo-Arg, D-homo-Arg, Met, D-Met, Ile, D-Ile, Orn, or D-Orn; Methionine (M) with D-Met, S-Me-Cys, Be, D-Ile, Leu, D-Leu, Val, or D-Val; Phenylalanine (F) with D-Phe, Tyr, D-Thr, L-Dopa, His, D-His, Trp, D-Trp, Trans-3, 4 or 5-phenylproline, AdaA, AdaG, cis-3, 4 or 5-phenylproline, Bpa, or D-Bpa; Proline (P) with D-Pro, L-I-thioazolidine-4-carboxylic acid, or D- or -L-1-oxazolidine-4-carboxylic acid (U.S. Pat. No. 4,511,390); Serine (S) with D-Ser, Thr, D-Thr, allo-Thr, Met, D-Met, Met (O), D-Met (O), L-Cys, or D-Cys; Threonine (T) with D-Thr, Ser, D-Ser, allo-Thr, Met, D-Met, Met (O), D-Met (O), Val, or D-Val; Tyrosine (Y) with D-Tyr, Phe, D-Phe, L-Dopa, His, or D-His; and Valine (V) with D-Val, Leu, D-Leu, Ile, D-Ile, Met, D-Met, AdaA, or AdaG.

Conservative variants of the insect or mammalian TRPV channels can be prepared according to methods for altering peptide sequences known in the art, and include those that may be found in references, which compile such methods, e.g., *Molecular Cloning: A Laboratory Manual*, J. Sambrook, et al., eds., Second Edition, Cold Spring Harbor, or *Current Protocols in Molecular Biology*, F. M. Ausubel, et al., eds., John Wiley & Sons, Inc. New York.

Conservative variants of TRPV channel may also be made by alteration of a nucleic acid encoding the TRPV polypeptide.

In certain embodiments, the screening method of the present invention may be a high-throughput screening. High-throughput screening (HTS) refers to a method for scientific experimentation that uses robotics, data processing and control software, liquid handling devices, and sensitive detectors. High-Throughput Screening or HTS allows a researcher to quickly conduct millions of biochemical, genetic or pharmacological tests. HTS is well known in the art, including, for example, U.S. Pat. Nos. 5,976,813; 6,472,144; 6,692,856; 6,824,982; and 7,091,048.

HTS uses automation to run a screen of an assay against a library of candidate compounds. An assay is a test for specific activity: usually inhibition or stimulation of a biochemical or biological mechanism. Specifically, an assay would be screening for inhibition or stimulation of the insect TRPV channel. Typical HTS screening libraries or "decks" can contain from 100,000 to more than 2,000,000 compounds.

The key labware or testing vessel of HTS is the microtiter plate, which is a small container, usually disposable and made of plastic that features a grid of small, open divots called wells. Modern microplates for HTS generally have either 384, 1536, or 3456 wells. These are all multiples of 96, reflecting the original 96 well microplate with 8×12 9 mm spaced wells.

To prepare for an assay, a researcher fills each well of the plate with the appropriate reagents that he or she wishes to conduct the experiment with. After some incubation time has passed to allow the reagent to absorb, bind to, or otherwise react (or fail to react) with the compounds in the wells, measurements are taken across all the plate's wells, either manually or by a machine. Manual measurements are often necessary when the researcher is using microscopy to (for example) seek changes that a computer could not easily determine by itself. Otherwise, a specialized automated analysis machine can run a number of experiments on the wells such as current or voltage measurements, colorimetric measurements, radioactivity counting, etc. In this case, the machine outputs the result of each experiment as a grid of numeric values, with each number mapping to the value obtained from a single well. A high-capacity analysis

IV. Formulations, Applications and Uses

In another aspect, the invention provides a compound selected by the screening assay described herein. It is to be understood that analogs, derivatives, isomers, and pharmaceutically acceptable salts of the compounds selected by the screening assays described herein as well as any formulations including the selected compound are also included herein.

The compound or group of compounds being determined or identified by the method according to the invention can be used in methods of insect control, e.g., by modulating insect feeding behavior. The identified compounds, analogs, derivatives, isomers, and pharmaceutically acceptable salts thereof are also referred to as "active agents" or "active ingredients" herein.

In some embodiments, the compound modulates the feeding behavior of an insect. As used herein, the term "feeding behavior" refers to the process by which organisms, such as insects obtain food. Without being bound by theory, the modulation of an insect TRPV elicits a signaling pathway that brings forth motor neuron modulation which may decrease feeding behavior of an insect, and such modulation of an insect TRPV channel in an insect may lead to a decrease in feeding behavior of such insect leading to the insect's death by starvation. Thus, again without being bound by theory, it is believed that compounds that modulate (e.g., activate or inhibit) an insect TRPV channel may be used as insecticides. This decrease in feeding behavior can be used to destroy insects in a particular location and thus control such insects. Thus, in some embodiments, the method comprises modulation of TRPV ion channel or family members in the insect with a compound identified by a screening method described herein.

Accordingly, in certain embodiments, the invention provides a method of insect control by modulating feeding behavior in an insect using a compound identified by the screening methods described herein. As used in context of methods of insect control, compounds identified by the screening methods described herein also include analogs, derivatives, isomers and pharmaceutically acceptable salts of such compounds.

In one embodiment, the methods and active agents described herein are applicable to insects that are agricultural or horticultural pest.

Examples of agricultural pests include, but are not limited to, Aphids (including *Aphis fabae, Aphis gossypii, Aphis pomi, Aulacorthum solani, Brevicoryne brassicae, Dysaphis plantaginea, Macrosiphum euphorbiae, Macrosiphum euphorbiae, Macrosiphum rosae, Myzus persicae, Nasonovia ribisnigri*); Whiteflies (including *Aleurodes* spp., *Bemisia* spp., *Dialeurodes* spp., *Trialeurodes* spp.); Planthoppers (including *Laodelphax striatellus, Nilaparvata lugens, Siphanta* spp., *Sogatella furcifera*); Leafhoppers (including *Amrasca* spp., *Empoasca* spp.); Scales (including *Aspidiotus* spp., *Chrysomphalus aonidum, Icerya purchase, Unaspis citri*); Mealybugs (including *Maconellicoccus* spp., *Paracoccus* spp., *Planococcus* spp.); Pollen beetles (including *Carpophilus* spp., *Meligethes* spp.); Thrips (including *Caliothrips* spp., *Frankliniella* spp., *Scirtothrips* spp., *Thrips* spp.); and Psyllids (including *Bactericera* spp., *Cacopsylla* spp., *Diaphorina citri, Paratrioza cockerelli*).

For example, vegetable and cole crops are sensitive to infestation by one or more of the following insect pests: aphids, brown plant hopper, alfalfa looper, armyworm, beet armyworm, artichoke plume moth, cabbage budworm, cabbage looper, cabbage webworm, corn earworm, celery leafeater, cross-striped cabbageworm, european corn borer, diamondback moth, green cloverworm, imported cabbageworm, melonworm, omnivorous leafroller, pickleworm, rindworm complex, saltmarsh caterpillar, soybean looper, tobacco budworm, tomato fruitworm, tomato hornworm, tomato pinworm, velvetbean caterpillar, and yellowstriped armyworm.

Likewise, pasture and hay crops such as alfalfa, pasture grasses and silage are often attacked by pests, such as armyworm, beef armyworm, alfalfa caterpillar, European skipper, a variety of loopers and webworms, as well as yellowstriped armyworms.

Fruit and vine crops are often susceptible to attack and defoliation by achema sphinx moth, amorbia, armyworm, citrus cutworm, banana skipper, blackheaded fireworm, blueberry leafroller, cankerworm, cherry fruitworm, citrus cutworm, cranberry girdler, eastern tent caterpillar, fall webworm, fall webworm, filbert leafroller, filbert webworm, fruit tree leafroller, grape berry moth, grape leaffolder, grapeleaf skeletonizer, green fruitworm, gummosos-batrachedra commosae, gypsy moth, hickory shuckworm, hornworms, loopers, navel orangeworm, obliquebanded leafroller, orrinivorous leafroller, omnivorous looper, orange tortrix, orangedog, oriental fruit moth, pandemis leafroller, peach twig borer, pecan nut casebearer, redbanded leafroller, redhumped caterpillar, roughskinned cutworm, saltmarsh caterpillar, spanworm, tent caterpillar, thecla-thecla basillides, tobacco budworm, tortrix moth, tufted apple budmoth, variegated leafroller, walnut caterpillar, western tent caterpillar, and yellowstriped armyworm.

Field crops such as canola/rape seed, evening primrose, meadow foam, corn (field, sweet, popcorn), cotton, hops, jojoba, peanuts, rice, safflower, small grains (barley, oats, rye, wheat, etc.), sorghum, soybeans, sunflowers, and tobacco are often targets for infestation by insects, including: armyworm, asian and other corn borers, banded sunflower moth, beet armyworm, bollworm, cabbage looper, corn rootworm (including southern and western varieties), cotton leaf perforator, diamondback moth, european corn borer, green cloverworm, headmoth, headworm, imported cabbageworm, loopers (including *Anacamptodes* spp.), obliquebanded leafroller, omnivorous leaftier, podworin, podworm, saltmarsh caterpillar, southwestern corn borer, soybean looper, spotted cutworm, sunflower moth, tobacco budworm, tobacco hornworm, velvetbean caterpillar, Bedding plants, flowers, ornamentals, vegetables and container stock are frequently fed upon by a host of insect pests such as armyworm, azalea moth, beet armyworm, diamondback moth, ello moth (hornworm), Florida fern caterpillar, lo moth, loopers, oleander moth, omnivorous leafroller, omnivorous looper, and tobacco Forests, fruit, ornamental, and nut-bearing trees, as well as shrubs and other nursery stock are often susceptible to attack from diverse insects such as bagworm, blackheaded budworm, browntail moth, california oakworm, douglas fir tussock moth, elm spanworm, fall webworm, fruit tree leafroller, greenstriped mapleworm, gypsy moth, Jack pine budworm, mimosa webworm, pine butterfly, redhumped caterpillar, saddleback caterpillar, saddle prominent caterpillar, spring and fall cankerworm, spruce budworm, tent caterpillar, tortrix, and western tussock moth.

Likewise, turf grasses are often attacked by pests such as armyworm, sod webworm, and tropical sod webworm.

It is also envisioned that the methods described herein are also applicable to pest control, wherein the pests are not insects but rather, e.g., nematodes, slugs or snails.

In one embodiment, the methods described herein are also applicable to insects that are parasites. Examples of some insect parasites are Braconid Wasps, family Braconidae; Ichneumonid Wasps, family Ichneumonidae; Chalcid Wasps, family Chalcidae; Tachinid Flies, family Tachonidae.

In certain other embodiments, the methods described herein may also be applicable to insects that are disease vectors. Vectors are organisms that can introduce a pathogen such as a bacterium or virus into a host organism to cause an infection or disease. Exemplary disease vector include, but are not limited to, mosquitoes, Ticks, Siphonaptera (fleas), Diptera (flies), Phthiraptera (lice) and Hemiptera (true bugs).

Once a compound suitable for insecticidal use is identified, the active ingredient, or formulations comprising them, may be applied directly to the target insects (i.e., larvae, pupae and/or adults), or to the locus of the insects. In one embodiment, the active ingredient or a formulation containing the active ingredient is applied directly to the adult insect. In one embodiment, the active agent is applied directly to the larvae and/or pupae of the target insect. In another embodiment, the active ingredient is applied to the locus of the insects.

Because compounds incorporating hydrophobic moieties will penetrate the insect cuticle, active agents can be conjugated with hydrophobic moieties. Hydrophobic moieties include, but are not limited to, lipids and sterols.

In one embodiment, the active ingredient or a formulation including the active ingredient may be applied as a spray. For example, the active ingredient may be applied as an agricultural spray in aerial crop dusting, an environmental spray to control biting insects, or as a topical spray for localized control of biting insects. The active ingredient may be formulated for the purpose for spray application such as an aerosol formulation. Spray application may be accomplished with a spray pump. The active ingredient may be also encapsulated within materials such as starch, flour and gluten in granular formulations.

In certain embodiments, the active ingredient or a formulation including the active ingredient may be applied in conjunction with other insecticides and/or pesticides such as organo-phosphates, synthetic pyrethroids, carbamates, chlorinated hydrocarbons, when used in agricultural and/or environmental insect control.

The active ingredient may be administered in an amount effective to induce the desired response as determined by routine testing. The actual effective amount will of course vary with the specific active ingredient, the target insect and its stage of development, the application technique, the desired effect, and the duration of the effect, and may be readily determined by the practitioner skilled in the art. "An effective amount of active ingredient" refers to the amount of active ingredient that modulates (activates or inhibits) an insect TRPV channel, e.g., modulates feeding behavior of an insect to achieve the desired insect control.

Methods of formulation are well known to one skilled in the art and are also found in Knowles, D A (1998) Chemistry and technology of agricultural formulations. Kluwer Academic, London, which is hereby incorporated by reference in its entirety. One skilled in the art will, of course, recognize that the formulation and mode of application may affect the activity of the active ingredient in a given application. Thus, for agricultural and/or horticultural use the TRPV inhibitors and/or agonists may be formulated as a granular of relatively large particle size (for example, 8/16 or 4/8 US Mesh), as water-soluble or water-dispersible granules, as powdery dusts, as wettable powders, as emulsifiable concentrates, as aqueous emulsions, as solutions, as suspension concentrate, as capsule suspensions, as soluble (liquid) concentrates, as soluble powders, or as any of other known types of agriculturally-useful formulations, depending on the desired mode of application. It is to be understood that the amounts specified in this specification are intended to be approximate only, as if the word "about" were placed in front of the amounts specified.

These formulations may be applied either as water-diluted sprays, or dusts, or granules in the areas in which insect control is desired. The formulations may contain as little as 0.1%, 0.2% or 0.5% to as much as 95% or more by weight of active ingredient, e.g. insect TRPV inhibitor.

"Dusts" are free flowing admixtures of the active ingredient with finely divided solids such as talc, natural clays, kieselguhr, flours such as walnut shell and cottonseed flours, and other organic and inorganic solids which act as dispersants and carriers for the toxicant; these finely divided solids have an average particle size of less than about 50 microns. A typical dust formulation useful herein is one containing 90 parts, 80 parts, 70 parts, 60 parts, 50 parts, 40 parts, 30 parts, 20 parts, preferably 10 parts, or less of the active ingredient, e.g., insect TRPV inhibitor or insect TRPV agonist. In one embodiment, the dust formulation may include 1 part or less of the active ingredient and 99 parts or more of talc.

Wettable powders, useful as formulations, are in the form of finely divided particles that disperse readily in water or other dispersant. The wettable powder is ultimately applied to the locus where insect control is needed either as a dry dust or as an emulsion in water or other liquid. Typical carriers for wettable powders include Fuller's earth, kaolin clays, silicas, and other highly absorbent, readily wet inorganic diluents. Wettable powders typically are prepared to contain about 5-80% of active ingredient, depending on the absorbency of the carrier, and usually also contain a small amount of a wetting, dispersing or emulsifying agent to facilitate dispersion. For example, a useful wettable powder formulation contains 80.0 parts of the active ingredient, 17.9 parts of Palmetto clay, and 1.0 part of sodium lignosulfonate and 0.3 part of sulfonated aliphatic polyester as wetting agents. Additional wetting agent and/or oil may be added to a tank mix for to facilitate dispersion on the foliage of the plant.

Other useful formulations are emulsifiable concentrates (ECs) which are homogeneous liquid compositions dispersible in water or other dispersant, and may consist entirely of the active ingredient, and a liquid or solid emulsifying agent, or may also contain a liquid carrier, such as xylene, heavy aromatic naphthas, isophorone, or other non-volatile organic solvents. For insecticidal application these concentrates are dispersed in water or other liquid carrier and normally applied as a spray to the area to be treated. The percentage by weight of the essential active ingredient may vary according to the manner in which the composition is to be applied, but in general comprises 0.5 to 95% of active ingredient by weight of the insecticidal composition.

Flowable formulations are similar to ECs, except that the active ingredient is suspended in a liquid carrier, generally water. Flowables, like ECs, may include a small amount of a surfactant, and will typically contain active ingredients in the range of 0.5 to 95%, frequently from 10 to 50%, by weight of the composition. For insecticidal application, flowables may be diluted in water or other liquid vehicle, and are typically applied as a spray.

Typical wetting, dispersing or emulsifying agents used in agricultural and/or horticultural formulations may include, but are not limited to, the alkyl and alkylaryl sulfonates and sulfates and their sodium salts; alkylaryl polyether alcohols; sulfated higher alcohols; polyethylene oxides; sulfonated animal and vegetable oils; sulfonated petroleum oils; fatty acid esters of polyhydric alcohols and the ethylene oxide addition products of such esters; and the addition product of long-chain mercaptans and ethylene oxide. Many other types of useful surface-active agents are available in commerce. Surface-active agents, when used, typically include 1 to 15% by weight of the composition.

Other useful formulations include suspensions of the active ingredient in a relatively non-volatile solvent such as water, corn oil, kerosene, propylene glycol, or other suitable solvents.

In certain embodiments, formulations for insecticidal applications may include simple solutions of the active ingredient in a solvent, in which it is completely soluble at the desired concentration, such as acetone, alkylated naphthalenes, xylene, or other organic solvents.

Granular formulations, wherein the active ingredient is carried on relative coarse particles, are of particular utility for aerial distribution or for penetration of cover crop canopy. Pressurized sprays, typically aerosols wherein the active ingredient is dispersed in finely divided form as a result of vaporization of a low-boiling dispersant solvent carrier may also be used. Water-soluble or water-dispersible granules are free flowing, non-dusty, and readily water-soluble or water-miscible. In use by the farmer on the field, the granular formulations, emulsifiable concentrates, flowable concentrates, aqueous emulsions, solutions, etc., may be diluted with water to give a concentration of active ingredient in the range of say 0.1% or 0.2% to 1.5% or 2%.

By far the most frequently used are water-miscible formulations for mixing with water then applying as sprays. Water miscible, older formulations include: emulsifiable concentrate, wettable powder, soluble (liquid) concentrate, and soluble powder. Newer, non-powdery formulations with reduced or no hazardous solvents and improved stability include: suspension concentrate, capsule suspensions, and water dispersible granules. Such formulations are preferably solutions and suspension, e.g., aqueous suspension and solutions, ethanolic suspension and solutions, aqueous/ethanolic suspension and solutions, saline solutions, and colloidal suspensions.

Alternatively, a sprayable wax emulsion formulation may be used. The formulation contains the active ingredient, in an amount from about 0.01% to 75% by weight. The aqueous wax emulsions are broadly described in U.S. Pat. No. 6,001,346, which is hereby incorporated by reference in its entirety. The TRPV inhibitors of the methods described herein can have a viscosity appropriate for use in aerial or backpack spray applications.

The biodegradable wax carrier comprises at least about 10% by weight of the formulation. The biodegradable wax carrier is selected from the group consisting of paraffin, beeswax, vegetable based waxes such as soywax (soybean based), and hydrocarbon based waxes such as Gulf Wax Household Paraffin Wax; paraffin wax, avg. m.p. 53C (hexacosane), high molecular weight hydrocarbons), carnauba wax, lanolin, shellac wax, bayberry wax, sugar cane wax, microcrystalline, ozocerite, ceresin, montan, candelilla wax, and combinations thereof.

Formulations may also contain an emulsifier in an amount from about 1% to about 10% by weight. Suitable emulsifiers include lecithin and modified lecithins, mono- and diglycerides, sorbitan monopalmitate, sorbitan monooleate, sorbitan monolaurate, polyoxyethylene-sorbitan monooleate, fatty acids, lipids, etc. The emulsifiers provide or improve emulsification properties of the composition. The emulsifier can be selected from many products which are well known in the art, including, but not limited to, sorbitan monolaurate (anhydrosorbitol stearate, molecular formula $C_{24}H_{46}O_6$), ARLACEL 60, ARMOTAN MS, CRILL 3, CRILL K3, DREWSORB 60, DURTAN 60, EMSORB 2505, GLYCOMUL S, HODAG SMS, IONET S 60, LIPOSORB S, LIPOSORB S-20, MONTANE 60, MS 33, MS33F, NEWCOL 60, NIKKOL SS 30, NISSAN NONION SP 60, NONION SP 60, NONION SP 60R, RIKEMAL S 250, sorbitan c, sorbitan stearate, SORBON 60, SORGEN 50, SPAN 55, AND SPAN 60; other sorbitan fatty acid ester that may be used include sorbitan monopalmitate, sorbitan monostearate, sorbitan tristearate, sorbitan monooleate, sorbitan sesquioleate, sorbitan trioleate, sorbitan monooleate, sorbitan trioleate.

In certain embodiments, formulations can include a phagostimulant, such as corn oil, molasses, glycerol, or corn syrup, proteinaceous material (protein or hydrolyzed protein), sugars like sucrose, or food-based ingredients such as trimethylamine, putrescine, bacterial or yeast volatiles or metabolites, ammonium acetate, ammonium carbonate or other ammonia-emitting compounds. Acetic acid vapor can be provided by compounds that produce volatilized acetic acid, for example, aqueous acetic acid, glacial acetic acid, glacial (concentrated) acetic acid, or ammonium producing compounds such as but not restricted to ammonium hydroxide, ammonium carbonate, ammonium bicarbonate, ammonium acetate, etc.

In certain embodiments, the active ingredient may be formulated and/or applied with one or more second compounds. For example, various combinations of TRPV inhibitors and TRPV agonists may be used to obtain greater advantage. For example, both a TRPV inhibitor and TRPV agonist may be applied at the same time. As such in one embodiment, a formulation described herein may include both, a TRPV inhibitor and a TRPV agonist. In one embodiment, two or more active agents may be formulated together. In alternative embodiment, two or more active agents formulated together are all either TRPV inhibitors or are all TRPV agonists. Such combinations may provide certain advantages, such as, without limitation, exhibiting synergistic effects for greater control of insects or non-insect pests, reducing rates of application thereby minimizing any impact to the environment and to worker safety, controlling a broader spectrum of insects and non-insect pests, and improving tolerance by non-pest species, such as mammals and fish. Other second compounds include, without limitation, insecticides, pesticides, plant growth regulators, fertilizers, soil conditioners, or other agricultural and horticultural chemicals. The formulation may include such second compounds in an amount from about 0.002% to about 25% by weight of the composition.

In certain embodiments, the formulations of the present invention may contain visual attractants, e.g. food coloring.

A variety of additives may also be incorporated into the formulation. These additives typically change and/or enhance the physical characteristics of the carrier material and are, therefore, suitable for designing compositions having specific requirements as to the release rate and amount of the active ingredient, protection of the wax composition from weather conditions, etc. These additives are, among others, plasticizers, volatility suppressants, antioxidants, lipids, various ultraviolet blockers and absorbers, or antimicrobials, typically added in amounts from about 0.001% to about 10%, more typically between 1-6%, by weight.

Plasticizers, such as glycerin or soy oil affect physical properties of the composition and may extend its resistance to environmental destruction.

Antioxidants, such as vitamin E, BHA (butylated hydroxyanisole), BHT (butylated hydroxytoluene), and other antioxidants which protect the bioactive agent from degradation, may be added in amounts from about 0.1% to about 3%, by weight.

Ultraviolet blockers, such as beta-carotene, lignin or p-aminobenzoic acid protect the bioactive agents from light degradation may be added in amounts from about 1% to about 3%, by weight.

Antimicrobials, such as potassium sorbate, nitrates, nitrites, and propylene oxide, protect the bioactive agents from microbial destruction may be added in amounts from 0.1% to about 2% by weight.

Adjuvants can also be added to the formulation. An "adjuvant" is broadly defined as any substance added to the spray tank, separate from the insecticide formulation that will improve the performance of the insecticide. These may include, but are not limited to: wetter-spreaders, stickers, penetrants, compatibility agents, buffers, and so on.

Other compounds and materials may also be added provided they do not substantially interfere with the activity of active ingredient. Whether or not an additive substantially interferes with the active ingredient's activity can be determined by standard test formats, involving direct comparisons of efficacy of the composition of the active ingredient without an added compound and the composition of the active ingredient with an added compound.

It was discovered that an insect will stop eating after ingesting a TRPV channel activating compound. For example ingesting a TRPV ion gated channel agonist can cause an insect to stop eating. Thus, in one embodiment, the compounds may be formulated with a food source for insects, e.g., formulated with compounds in insect diet. In another embodiment, the compounds may be formulated with sucrose. Without wishing to be bound by theory, the insect will feed on such mixtures and stop eating.

In certain embodiments, the active agent may be applied to feeding locus of insects. This inhibits insect feeding leading to starvation of insects. In one embodiment, the active agent is applied as a spray to locus of insects, e.g., feeding locus.

In one embodiment, the active agent may be applied to insect traps. For example, the trap may be coated with the active agent or trap may be loaded with insect food comprising an active agent.

V. Regulatable Expression Vectors and System

In certain embodiments, the present invention relates to an expression vector that comprises a nucleic acid molecule encoding an insect TRPV channel.

In one embodiment, the expression vector includes a first nucleic acid molecule encoding a Nanchung protein and a second nucleic acid molecule encoding an Inactive protein. Preferably, upon expression of the Nanchung and Inactive proteins in a cell, a functional insect TRPV channel is formed.

In certain other embodiments, the present invention relates to an expression vector system that comprises a first regulatable expression vector comprising a first nucleic acid molecule and a second regulatable expression vector comprising a second nucleic acid molecule. The expression vectors encode an insect TRPV channel.

In one embodiment, the first expression vector includes a first nucleic acid molecule encoding a Nanchung protein and the second expression vector comprises a second nucleic acid molecule encoding an Inactive protein.

For example, the first nucleic acid molecule is selected from the group consisting of a) a polynucleotide molecule comprising a nucleic acid molecule having a sequence selected from the group consisting of SEQ ID NOS: 1-27; b) a polynucleotide molecule having at least about 70% sequence identity to the sequence of SEQ ID NOS: 1-27; and c) a fragment of the polynucleotide molecule of a) or b)).

For example, the second nucleic acid molecule is selected from the group consisting of a) a polynucleotide molecule comprising a nucleic acid molecule having a sequence selected from the group consisting of SEQ ID NOS: 28-53; b) a polynucleotide molecule having at least about 70% sequence identity to the sequence of SEQ ID NOS: 28-53; and c) a fragment of the polynucleotide molecule of a) or b).

Preferably, upon co-expression of the Nanchung and Inactive proteins in a cell, a functional insect TRPV channel is formed.

The nucleic acid sequences of Nanchung and Inactive subunits of the TRPV channel as well as the corresponding amino acid sequences, their origins and accession numbers (if available) are summarized in Table 1 below.

TABLE 1

| SEQ ID NO. | DESCRIPTION | ORGANISM | ACCESSION NO. |
|---|---|---|---|
| 1 | Nanchung DNA | *Drosophila melanogaster* | NM_140439.3 |
| 2 | Nanchung DNA | *Drosophila melanogaster* | NM_001274904.1 |
| 3 | Nanchung DNA | *Musca domestica* | XM_005180432 |
| 4 | Nanchung DNA | *Ceratitis capitata* | XM_004537685.1 |
| 5 | Nanchung DNA | *Anopheles gambiae* | XM_320300.4 |
| 6 | Nanchung DNA | *Aedes aegypti* | XM_001652374.1 |
| 7 | Nanchung DNA | *Culex quinquefasciatus* | XM_001847084 |
| 8 | Nanchung DNA | *Tribolium castaneum* | XM_962803.1 |
| 9 | Nanchung DNA | *Bombyx mori* | XM_004923013.1 |
| 10 | Nanchung DNA | *Anopheles darlingi* | gi\|312376269 |
| 11 | Nanchung DNA | *Acyrthosiphon pisum* | XM_001947872.2 |
| 12 | Nanchung DNA | *Dendroctonus ponderosae* | gi\|459669722 |
| 13 | Nanchung DNA | *Harpegnathos saltator* | gi\|307201159 |
| 14 | Nanchung DNA | *Nasonia vitripennis* | XM_001606052.2 |
| 15 | Nanchung DNA | *Megachile rotundata* | XM_003706124.1 |
| 16 | Nanchung DNA | *Apis mellifera* | XM_625167.3 |

TABLE 1-continued

| SEQ ID NO. | DESCRIPTION | ORGANISM | ACCESSION NO. |
| --- | --- | --- | --- |
| 17 | Nanchung DNA | *Apis florea* | XM_003689958.1 |
| 18 | Nanchung DNA | *Pediculus humanus corporis* | XM_002427918.1 |
| 19 | Nanchung DNA | *Danaus plexippus* | gi\|357621160 |
| 20 | Nanchung DNA | *Solenopsis invicta* | gi\|322788678 |
| 21 | Nanchung DNA | *Acromyrmex echinatior* | gi\|332030918 |
| 22 | Nanchung DNA | *Camponotus floridanus* | gi\|307175924 |
| 23 | Nanchung DNA | *Myzus persicae* | In-house |
| 24 | Nanchung DNA | *Bemisia tabaci* | In-house |
| 25 | Nanchung DNA | *Euschistus heros* | In-house |
| 26 | Nanchung DNA | *Nilaparvata lugens* | In-house |
| 27 | Nanchung DNA | *Schistocerca americana* | In-house |
| 28 | Inactive DNA | *Drosophila melanogaster* | NM_132125.1 |
| 29 | Inactive DNA | *Musca domestica* | XM_005180960.1 |
| 30 | Inactive DNA | *Ceratitis capitata* | XM_004529418.1 |
| 31 | Inactive DNA | *Aedes aegypti* | XM_001659838.1 |
| 32 | Inactive DNA | *Culex quinquefasciatus* | XM_001864290.1 |
| 33 | Inactive DNA | *Anopheles gambiae* | XM_310685.5 |
| 34 | Inactive DNA | *Tribolium castaneum* | TC012368 |
| 35 | Inactive DNA | *Megachile rotundata* | XM_003704618.1 |
| 36 | Inactive DNA | *Apis mellifera* | XM_001121881.2 |
| 37 | Inactive DNA | *Apis florea* | XM_003690679.1 |
| 38 | Inactive DNA | *Pediculus humanus corporis* | XM_002432337.1 |
| 39 | Inactive DNA | *Acromyrmex echinatior* | gi\|332020355 |
| 40 | Inactive DNA | *Harpegnathos saltator* | gi\|307206889 |
| 41 | Inactive DNA | *Bombus impatiens* | XM_003485651.1 |
| 42 | Inactive DNA | *Bombus terrestris* | XM_003396143.1 |
| 43 | Inactive DNA | *Dendroctonus ponderosae* | gi\|478256802 |
| 44 | Inactive DNA | *Nasonia vitripennis* | XM_001602538.2 |
| 45 | Inactive DNA | *Camponotus floridanus* | gi\|307168683 |
| 46 | Inactive DNA | *Danaus plexippus* | gi\|357618515 |
| 47 | Inactive DNA | *Bombyx mori* | XM_004925264.1 |
| 48 | Inactive DNA | *Acyrthosiphon pisum* | XM_001950061.2 |
| 49 | Inactive DNA | *Solenopsis invicta* | GL767538.1 |
| 50 | Inactive DNA | *Schistocerca americana*, DNA partial | In-house |
| 51 | Inactive DNA | *Myzus persicae* | In-house |
| 52 | Inactive DNA | *Bemisia tabaci* | In-house |
| 53 | Inactive DNA | *Euschistus heros* | In-house |
| 54 | Nanchung PROT | *Drosophila melanogaster* | NP_648696.2 |
| 55 | Nanchung PROT | *Drosophila melanogaster* | NP_001261263.1 |
| 56 | Nanchung PROT | *Musca domestica* | XP_005180489.1 |
| 57 | Nanchung PROT | *Ceratitis capitata* | XP_004537742.1 |
| 58 | Nanchung PROT | *Anopheles gambiae* | XP_320300.4 |
| 59 | Nanchung PROT | *Aedes aegypti* | XP_001652424.1 |
| 60 | Nanchung PROT | *Culex quinquefasciatus* | XP_001847136.1 |
| 61 | Nanchung PROT | *Tribolium castaneum* | XP_967896.1 |
| 62 | Nanchung PROT | *Bombyx mori* | XP_004923070.1 |
| 63 | Nanchung PROT | *Anopheles darlingi* | EFR23411.1 |
| 64 | Nanchung PROT | *Acyrthosiphon pisum* | XP_001947907.2 |
| 65 | Nanchung PROT | *Dendroctonus ponderosae* | ERL84850.1 |
| 66 | Nanchung PROT | *Harpegnathos saltator* | EFN81068.1 |
| 67 | Nanchung PROT | *Nasonia vitripennis* | XP_001606102.2 |
| 68 | Nanchung PROT | *Megachile rotundata* | XP_003706172.1 |
| 69 | Nanchung PROT | *Apis mellifera* | XP_625170.3 |
| 70 | Nanchung PROT | *Apis florea* | XP_003690006.1 |
| 71 | Nanchung PROT | *Pediculus humanus corporis* | XP_002427963.1 |
| 72 | Nanchung PROT | *Danaus plexippus* | EHJ73092.1 |
| 73 | Nanchung PROT | *Solenopsis invicta* | EFZ14282.1 |
| 74 | Nanchung PROT | *Acromyrmex echinatior* | EGI70573.1 |
| 75 | Nanchung PROT | *Camponotus floridanus* | EFN65752.1 |
| 76 | Nanchung PROT | *Myzus persicae* | In-house |
| 77 | Nanchung PROT | *Bemisia tabaci* | In-house |
| 78 | Nanchung PROT | *Euschistus heros* | In-house |
| 79 | Nanchung PROT | *Nilaparvata lugens* | In-house |
| 80 | Nanchung PROT | *Schistocerca americana* | In-house |
| 81 | Inactive PROT | *Drosophila melanogaster* | NP_572353.1 |
| 82 | Inactive PROT | *Musca domestica* | XP_005181017.1 |
| 83 | Inactive PROT | *Ceratitis capitata* | XP_004529475.1 |
| 84 | Inactive PROT | *Aedes aegypti* | XP_001659888.1 |
| 85 | Inactive PROT | *Culex quinquefasciatus* | XP_001864325.1 |
| 86 | Inactive PROT | *Anopheles gambiae* | XP_310685.5 |
| 87 | Inactive PROT | *Tribolium castaneum* | EFA10736.1 |
| 88 | Inactive PROT | *Megachile rotundata* | XP_003704666.1 |
| 89 | Inactive PROT | *Apis mellifera* | XP_001121881.1 |
| 90 | Inactive PROT | *Apis florea* | XP_003690727.1 |
| 91 | Inactive PROT | *Pediculus humanus corporis* | XP_002432382.1 |
| 92 | Inactive PROT | *Acromynnex echinatior* | EGI60788.1 |
| 93 | Inactive PROT | *Harpegnathos saltator* | EFN84766.1 |

TABLE 1-continued

| SEQ ID NO. | DESCRIPTION | ORGANISM | ACCESSION NO. |
| --- | --- | --- | --- |
| 94 | Inactive PROT | Bombus impatiens | XP_003485699.1 |
| 95 | Inactive PROT | Bombus terrestris | XP_003396191.1 |
| 96 | Inactive PROT | Dendroctonus ponderosae | ERL85467.1 |
| 97 | Inactive PROT | Nasonia vitripennis | XP_001602588.2 |
| 98 | Inactive PROT | Camponotus floridanus | EFN61724.1 |
| 99 | Inactive PROT | Danaus plexippus | EHJ71463.1 |
| 100 | Inactive PROT | Bombyx mori | XP_004925321.1 |
| 101 | Inactive PROT | Acyrthosiphon pisum | XP_001950096.1 |
| 102 | Inactive PROT | Solenopsis invicta | EFZ13594.1 |
| 103 | Inactive PROT | Schistocerca americana, DNA partial | In-house |
| 104 | Inactive PROT | Myzus persicae | In-house |
| 105 | Inactive PROT | Bemisia tabaci | In-house |
| 106 | Inactive PROT | Euschistus heros | In-house |

The expression vectors and systems may further include a regulatable promoter system. Examples of promoter systems that have been developed for regulatable gene expression systems include tetracycline-responsive (Tet), a RU-486-inducible promoter, an ecdysone-inducible promoter, a rapamycin-inducible promoter, and a metallothionein promoter.

Unlike commonly used tet-on or tet-off systems, which use hybrid Tet repressors fused to transactivation domains of other proteins, the expression vectors and system of the present invention uses a non-hybrid, native Tet repressor. By using the non-hybrid, native Tet repressor, production of Nan, Iav or mTRPV4 by adenovirus packaging cells may be suppressed. exclusively suppresses. As such, according to the methods of the present invention, adenovirus was packaged by modified HEK293 cells constitutively expressing non-hybrid, native Tet repressor. The Tet repressor binds to tet operators in modified CMV promoter without tetracyclin and shuts down the promoter. That is why packaging cells are not poisoned by toxic transgenes. Other methods of repressing expression of transgenes during virus packaging may be used.

Specifically, according to certain embodiments of the present invention, the Tet system may be used to regulate expression of the Nanchung and Inactive protein nucleic acids of the insect TRPV channel.

In certain embodiments of the present invention, the regulatable promoter system includes at least one Tet repressor binding site. Preferably, the regulatable promoter system includes two or more Tet repressor binding sites. Most preferably, the regulatable promoter system includes two Tet repressor binding sites. The Tet response elements-based system is well characterized and was previously described by Gossen and Bujuard (*Proc Nat Acad Sci USA*, 89:5547-5551, 1992).

In certain embodiments, the regulatable promoter may be a minimal cytomegalovirus (CMV) promoter operably linked to the gene of interest. The promoter system may be regulatable by tetracycline or doxycycline.

In certain embodiments, the expression vectors further include a recombinant adenovirus core.

In one embodiment, an adenovirus shuttle vector, pENTCMV1-TetO may be used. One of skill in the art will understand that alternative promoters, enhancers, other regulatory elements, and nucleic acids may be used in the construction of the tet-regulatable pENTCMV1-TetO vector of the present invention. As shown in FIG. 1, one pENTCMV1-TetO vector includes a modified cytomegalovirus (CMV) promoter that includes Tet repressor binding sites for expression-less packaging of adenoviruses in cells, a TRP channel coding region that includes nucleic acid sequences for either Nanchung or Inactive proteins of the TRPV channel, a nucleic acid sequence of a fluorescent protein, such as AcGFP1, flanked by two FLAG epitope tags.

As such, in certain embodiments, the present invention relates to an expression vector that includes adenovirus core origin; a transient receptor potential V (TRPV) channel coding region comprising; a third nucleic acid encoding a fluorescent protein flanked by two nucleic acids encoding epitope tags; and a regulatable promoter system. The TRPV coding region includes coding regions of Nanchung protein, i.e., first nucleic acid (e.g., SEQ ID NO: 2; NCBI Reference Sequence: NM_001274904.1) or Inactive protein, i.e., second nucleic acid (e.g., SEQ ID NO: 28; NCBI Reference Sequence: NM_132125.1) of the TRPV channel where nucleic acid sequences of Nanchung and Inactive are optimized for mammalian expression. It may also include coding region for mouse TRPV4 channel (e.g., SEQ ID NO: 2; NCBI Reference Sequence: NM_001274904.1) The regulatable promoter system includes at least one but preferably two or more Tet repressor binding sites and a minimal cytomegalovirus promoter operably linked to the TRPV channel coding region.

In certain other embodiments, the present invention relates to an expression vector system that includes a first expression vector comprising a first polynucleotide molecule comprising a nucleic acid sequence selected from SEQ ID NOS: 1-27 and encoding a Nanchung protein of the TRPV channel; a second expression vector comprising a second polynucleotide molecule comprising a nucleic acid selected from SEQ ID NOS: 28-53 and encoding an Inactive protein of the TRPV channel. The first and the second expression vectors further comprise an adenovirus core origin, a third nucleic acid encoding a fluorescent protein, nucleic acids encoding epitope tags, a regulatable promoter system comprising a Tet repressor binding site and a minimal cytomegalovirus promoter operably linked to the TRPV channel coding region, wherein the first and the second expression vectors are optimized for mammalian expression.

In some embodiments, the pENTCMV1-TetO vector may include a Kozak-like consensus sequence to facilitate expression of the TRPV nucleic acids. (See, for example, Kozak, M, *J. Biol. Chem.*, 266(30): 19867-19870, 1991.) Any suitable Kozak-like consensus sequence may be included in the vectors of the present.

VI. Adenovirion Production

Adenovirions, which include the adenovirus expression vectors of the present invention, can be produced using the following methodology.

The methods generally involve the steps of introducing the vector containing the gene of interest (e.g., Nan or Jay) and adenovirus coding regions (i.e., adenovirus expression vector) into a producer cell capable of being expressed in the producer cell (e.g., *Escherichia coli* cells). The adenovirus expression vector may be introduced into the producer cell using standard transfection techniques known to one of skill in the art (Zoltukhin et al., Gene Therapy, 6:973-985, 1999).

Specifically, according to one embodiment of the present invention, pENTCMV1-TetO vectors (Welgen, Mass.) containing tagged Nanchung, Inactive or TRPV4 expression constructs were treated with LR Clonase II (Life Technologies, Grand Island, N.Y.) and ligated to a pAdREP plasmid (Welgen, Mass.), which contained the remaining adenovirus genome. The recombination products were transformed into *Escherichia coli* cells, the positive clones were selected, and cosmid DNA was purified. The purified cosmid DNA was transfected into HEK293-TetR cells which produced Tet repressor preventing expression of TRPV channels by adenovirus packaging cells.

The adenovirions are then harvested from the supernatant of transfected HEK293-TetR cells. The adenovirions may be purified and concentrated by methods known in the art. The amplified recombinant adenovirus was purified on 2 sequential cesium chloride gradients and then dialyzed with a buffer (PBS, 10% glycerol, pH7.4) to reduce the salt concentration The adenovirions formed from the Tet-regulatable adenovirus vectors may be delivered to a cell line that can express the proteins of interest.

VII. Cells

The present invention also relates to a cell that includes the expression vectors or systems described herein.

Preferably, the Nanchung and Inactive proteins of the insect TRPV channel are co-expressed in the cell. The Nanchung and Inactive proteins may be co-expressed at varying ratios, preferably, the ratio of the Nanchung to Inactive proteins co-expressed in the first cell is about 3:1 to about 1:3, more preferably about 1:1.

Preferably, the adenovirions are added to the cells at the appropriate multiplicity of infection according to standard transduction methods appropriate for the particular target cells. Titers of adenovirions to administer can vary, depending upon the target cell type and the particular viral vector, and may be determined by those of skill in the art without undue experimentation. Adenovirions may be administered in a physiologically acceptable carrier. In general, a "physiologically acceptable carrier" is one that is not toxic or unduly detrimental to the cell line. Exemplary physiologically acceptable carriers include sterile, pyrogen-free, phosphate buffered saline. Physiologically-acceptable carriers include pharmaceutically-acceptable carriers.

The cell line may be an insect cell line, such as Sg9 (ATCC# CRL-1711) or Schneider 2 (S2) cells (Life Technologies, #R690-07), frog (*Xenopus*) oocytes, or a mammalian cell line, such as mouse, hamster, human cell line, or any other cell line that does not normally expresses Nanching and Inactive proteins. One example of a mammalian cell line suitable for use with the vector expression system of the present invention includes Chinese hamster ovary (CHO-K1) cells (ATCC# CCL-61).

In certain embodiments, the cell line co-expresses the Nanchung and Inactive proteins at a ratio of 3:1, 2:1, 1:1, 1:2, and 1:3. Preferably, the cell line co-expresses the Nanchung and Inactive proteins at a ratio of 1:1.

In some embodiments, a cell expressing a recombinant nucleic acid sequence encoding a TRPV channel is a cell that has been transformed with an expression vector comprising a nucleotide sequence encoding an insect TRPV channel such as, but not limited to the TRPV channel proteins discloses herein. Methods for transforming cells that would be known to one of ordinary skill in the art include, but are not limited to, infection using viral vectors, lipofection, electroporation, particle bombardment, and transfection. Detailed procedures for representative methods can be found in Sambrook & Russell, 2001, and references cited therein. Useful expression vectors and methods of introducing such vectors into cells or expression of the encoded polypeptide are also known to one of ordinary skill in the art. For example, a plasmid expression vector can be introduced into a cell by calcium-phosphate mediated transfection, DEAE-Dextran-mediated transfection, lipofection, polybrene- or polylysine-mediated transfection, electroporation, or by conjugation to an antibody, gramacidin S, artificial viral envelopes, or other intracellular carriers. A viral expression vector can be introduced into a cell in an expressible form by infection or transduction, for example, or by encapsulation in a liposome.

When a cell expressing a recombinant nucleic acid sequence encoding an insect TRPV channel gene product has been produced, these cells can then be employed in testing candidate compounds for an ability to modulate cation transport in the cell through the TRPV channel. The exemplary methods for testing cation transport in the cells were described above as well as presented in the Examples sections below. Other applicable methods would be known to those of skill in the art upon consideration of this disclosure.

EXAMPLES

The following Examples provide illustrative embodiments. In light of the present disclosure and the general level of skill in the art, those of skill will appreciate that the following Examples are intended to be exemplary only and that numerous changes, modifications, and alterations can be employed without departing from the scope of the presently disclosed subject matter.

Experimental Materials and Procedures Employed in the Examples

I. Test Compounds

Ruthenium Red was purchased from Calbiochem. Pymetrozine and GSK10116790A were purchased from Sigma (St. Lois, Mo.), pyrifluquinazon was purchased from ChemService Inc., (West Chester, Pa.), pyrifluquinazon metabolite B was purchased from Wako Pure Chemical Industries, LTD (Richmond, Va.)

II. Expression Constructs/Vector Construction

To produce constructs of the present invention, complementary DNAs (cDNAs) encoding for *Drosophila* Nanchung (NCBI NM_001274904.1; SEQ ID NO: 2) and Inactive (NCBI NM_132125.1; SEQ ID NO: 28) proteins were synthesized by Life Technologies (Grand Island, N.Y.) with addition of sequence encoding for FLAG antibody tag (DYKDDDDK; SEQ ID NO: 107) at the C-termini of both, Nanchung and Inactive.

Complementary DNA for mouse TRPV4 (mTRPV4)protein (NCBI NM_001274904.1) containing sequence encoding for FLAG epitope was purchased from Origene (Rockville, Md.). Insect cDNAs were codon optimized for mammalian expression.

The Nanchung-FLAG and Inactive-FLAG cDNAs were subcloned into Bgl II and HindIII sites of the modified pAcGFP1-Hyg-N1 vector (Clontech, Kyoto, Japan), which contained a FLAG tag at the C-terminus of the AcGFP moiety (pAcGFP1-Hyg-N1-FLAG).

The mTRPV4-FLAG cDNA was PCR amplified with VP1.5F primer (5'-GGACTTTCCAAAATGTCG-3'; SEQ ID NO: 108) and mTRPV4_Hind3R primer (5'-CCGGC-CGTTTATCACTACAGAATTCGAAGCTTAACCT-TATCGTCGTCATCCTTGTA-3'; SEQ ID NO: 109), digested with BglII and HindIII, and subcloned into pAcGFP1-Hyg-N1-FLAG vector.

The pAcGFPN1_Hygro vector contained a FLAG tag at the C-terminus of AcGFP.

As the pAcGFPN1_Hygro vector contained a FLAG tag at the C-terminus of AcGFP moiety, these cloning procedures added AcGFP protein flanked by two FLAG epitope tags to the carboxyl termini of both Nanchung, Inactive and mTRPV4.

Epitope-tagged expression constructs were PCR cloned into adenovirus shuttle vector pENTCMV1-TetO provided by Welgen, Inc. (Worceter, Mass.).

The pENTCMV1-TetO vector contained two Tet repressor binding sites within modified CMV promoter which repress transcription of gene of interest in the cell lines expressing Tet repressor.

III. Production of Recombinant Adenoviruses pENTCMV1-TetO vectors containing tagged Nanchung, Inactive and TRPV4 expression constructs were treated with LR Clonase II (Life Technologies, Grand Island, N.Y.) and ligated to a pAdREP plasmid (provided by Weigen), which contains the remaining adenovirus genome.

The recombination products were transformed into *Escherichia coli* cells, positive clones were selected, and cosmid DNAs were purified. The purified cosmid DNA was digested with Pac I and then transfected into HEK293-TetR cells which produce Tet repressor preventing expression of TRPV channels by adenovirus packaging cells. The cells were grown in Dulbecco's modified Eagle's medium. The adenovirus plaques were seen 7 days after transfection. Adenoviruses were purified from large-scale cultures grown on CellSTACK Culture Chambers (Corning Inc., Lowell, Mass.).

To determine concentration of viral particles 10 µl of viral sample was added mixed with 990 µl 0.1% SDS and incubated at room temperature for 15 min. The optical density of the sample was measured at 260 nM (A260) and viral titer calculated from formula: viral particles/ml=A260× $1.1 \times 10^{14}$.

IV. $Ca^{2+}$ Mobilization and Membrane Potential Assays

The effects of test compounds on insect and mouse TRPV channel activity were tested on hamster CHO-K1 cells (ATCC # CCL-61)) transduced with adenoviruses expressing tagged Nan, Iav, or mTRPV4 proteins. The cells were transduced with indicated amount of viral particles per cell, and seeded on poly-D-lysine coated 96-well plates (Greiner Bio-One, Frickenhausen, Germany) in 100 µl of media, at a density 40,000 cells/well. The cells were kept overnight at 37° C., followed by 3 days at 25° C.° C. The media was changed on day 2 after seeding.

Both $Ca^{2+}$ mobilization and changes of membrane potential were measured using FLIPR-TETRA instrument (Molecular Devices, Sunnyvale, Calif.).

$Ca^{2+}$ mobilization was measured using FLUO4 fluorescent probe (Life Technologies, Grand Island, N.Y.). The cells were loaded with 50 µl of Hank's buffered salt solution (HBSS), containing 4 µM fluo-4AM, 5 mM probenecid and 0.02% pluoronic for 2 hrs at 25° C. The dye was then discarded, 50 µl of HBSS was added to each well and the plate fluorescent measurements are read on the FLIPR instrument at 470-495 nm/515-575 nm excitation/emission according to the manufacturer's instructions Test compounds were dissolved in DMSO and added to the cells in 50 µl HBSS, yielding a final DMSO concentration of 0.2%. Fluorescence was monitored for 10 minutes at 1 second intervals.

Changes of membrane potential were measured using similar procedure, except that cells were loaded with proprietary membrane potential dye (Molecular Devices, Cat# R8042) in HBSS buffer and fluorescence was monitored at 510-545 nm/565-625 nm excitation/emission.

V. Western Blot

Adenovirus-transduced cells were seeded on 35 mm dishes. The cells were washed with phosphate-buffered saline and lysed in 300 µl of NuPAGE LDS sample buffer (Life Technologies) supplemented with a protease inhibitor cocktail (Sigma Aldrich) and TurboDNAse (Ambion). The samples were electrophoresed using NuPaGe 4-12% Bis-Tris Pre-Cast gel system (Life Technologies, Grand Island, N.Y.), and transferred to nitrocellulose filter TRP proteins were detected with the antibody to AcGFP moiety (Clontech, Mountain View, Calif.), and blots developed with ECL reagent (Thermo Scientific).

Example I

To test the hypothesis that insect TRPV channels are direct targets of insect feeding blocking compounds, TRPV channel proteins, Nan and Iav subunits were expressed in CHO-K1 cell line either alone or in combination as fusion proteins containing AcGFP and two FLAG antibody epitope tags on their carboxy termini, as illustrated in FIG. 1.

CHO-K1 cells were transduced with adenoviruses expressing tagged *Drosophila* Nan and Iav. Adeno-virus-mediated gene delivery allowed for expression of the gene of interest, optimize expression levels and stoichiometry of subunits, as well as prevention of toxic effects of Nan and Iav by maintaining virus infected cell at room temperature.

To prevent toxicity of Nan and Iav during the adenovirus production stage, adenoviral constructs containing Tet repressor binding sites within modified CMV promoter (FIG. 1) were used. The presence of Tet repressor binding sites inhibits expression of the genes of interest in adenovirus packaging cells producing Tet repressor.

The CHO cells expressing *Drosophila* Nan and Iav either alone or in combination were treated with two commercially available insecticides, pymetrozine, which has been shown to affect chordotonal organs (Ausborn et al., 2005).), a structurally related compound, pyrifluquinazon and de-acetylated form of pyrifluquinazon, referred as Metabolite B. Molecular structures of the test compounds are shown in FIG. 2.

Given that mammalian TRP channels are permeable for several cations, including $Ca^{2+}$, cell responses were measured by monitoring $Ca^{2+}$ mobilization using $Ca^{2+}$ sensitive fluorescent probe FLUO4.

Both pyrifluquinazon (FIG. 2) and pymetrozine (data not shown) triggered $Ca^{2+}$ mobilization in the cells co-expressing Nan and Iav (FIG. 2D), but not in cells expressing these proteins alone (FIG. 2B and FIG. 2C) confirming genetic and morphological evidences that both Nan and Iav are required to form functional insect TRPV channels.

Figure 2A:
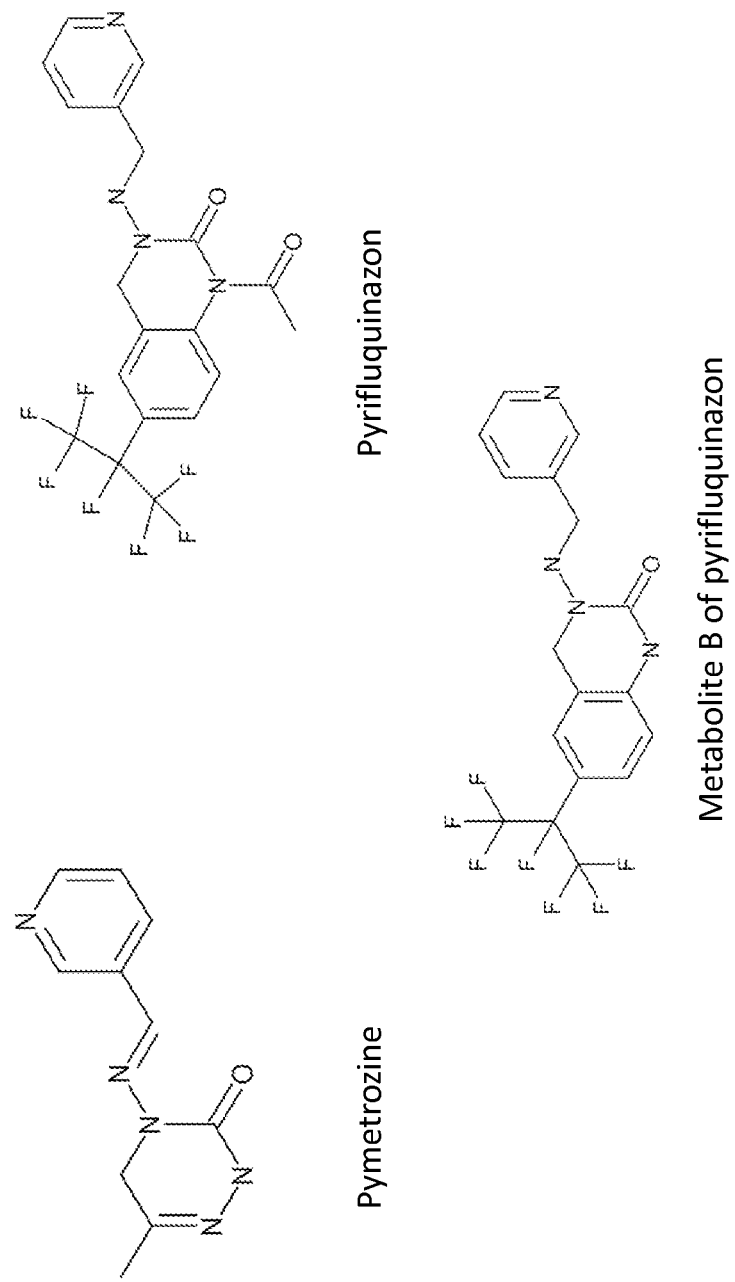
FIG. 2A depicts molecular structures of pymetrozine, pyrifluquinazon and its N-deacetylated form, Metabolite B.

Noteworthy, de-acetylated form of pyrifluquinazon (Metabolite B) was about 100 fold more potent than the parental compound (FIG. 2C).

Example II

To define optimal stoichiometry of Nan and Iav, ratios of Nan:Iav adenoviruses (1:0; 3:1; 1:1; 1:3; 0:1) were varied at four different infection rates; i.e., levels of viral particles (VP) per cells (2,000 VP/cell; 4,000 VP/cell; 8,000 VP/cell; and 16,000 VP/cell).

As evidenced by FIGS. 3A-D, the strongest response was observed at 1:1 ratios of Nan:Iav virus particles.

Figure 3A:
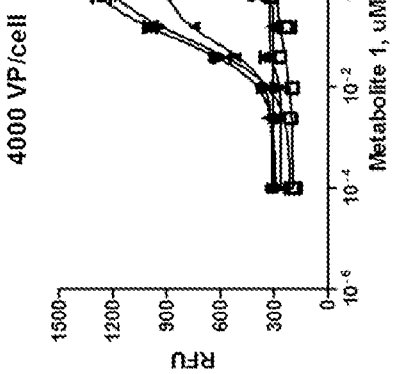
FIGS. 3A-D depict activation of $Ca^{2+}$ mobilization by pyrifluquinazon Metabolite B at different infection rates and different Nan:Iav expression ratios.
Figure 3B:
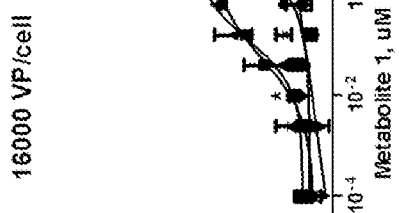
Figure 3C:
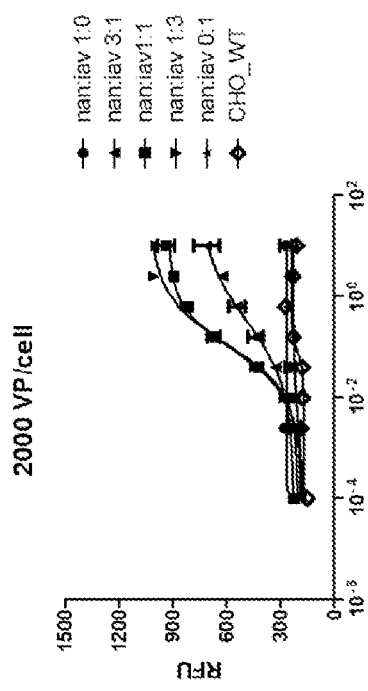
Figure 3D:
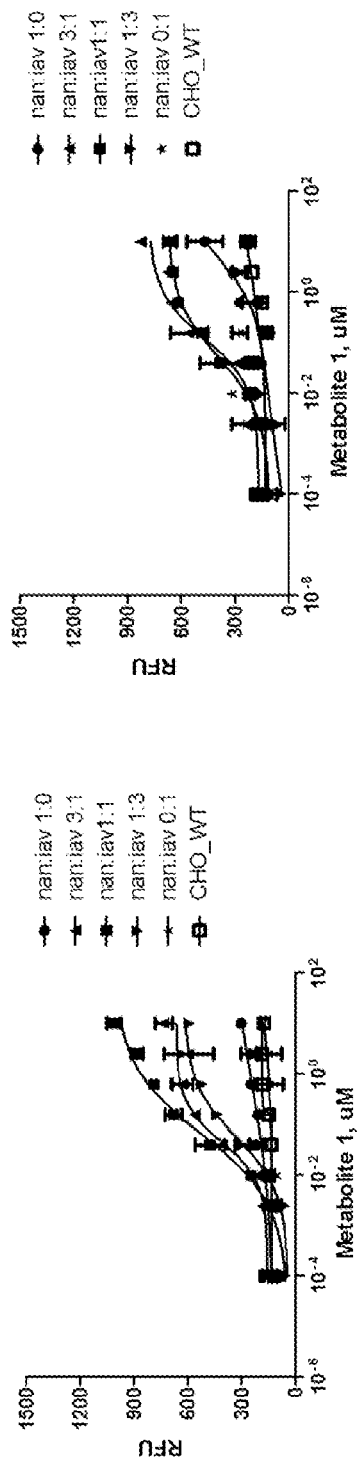
Figure 3E:
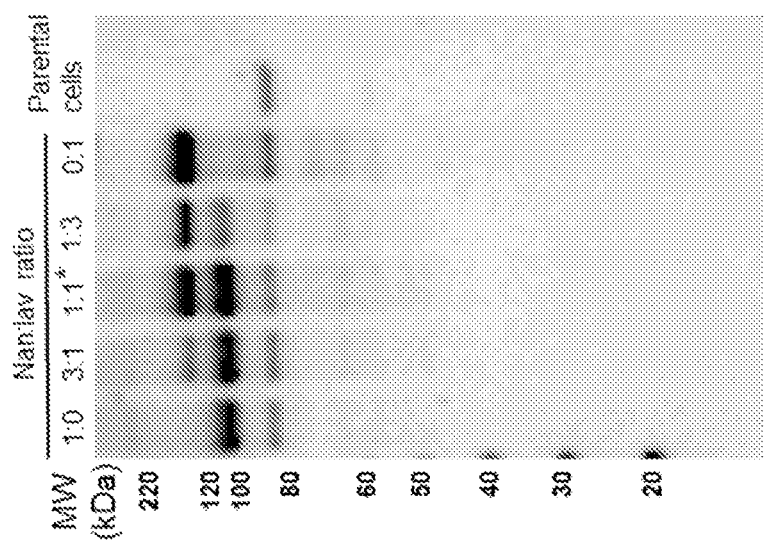
FIG. 3E depicts a photograph of a Western blot showing relative expression of Nan and Jay proteins detected by antibodies to a common AcGFP1 moiety.

To directly confirm that at 1:1 ratio of adenoviruses Nan and Iav proteins were present at equal levels, we verified expression levels of these proteins by Western blot (FIG. 3E). Nan and Iav fused with AcGFP constructs are predicted to produce proteins with molecular weights of 124 kDa (Nan) and 152 kDa (Iav). The difference in electrophoretic mobility made it possible to detect both Nan and Iav proteins on the same blot using antibodies to their common AcGFP tag.

As shown in FIG. 3E, at 1:1 ratios of adenoviruses Nan and Iav subunits were indeed expressed at approximately equal levels. The amplitude of response reached maximum at 4000 viral particles per cell and then diminished, indicating that too high density of TRPV channels can be detrimental.

Example III

Several lines of evidence indicate that test compounds activate insect TRPV channels on cell surface. First, response of cells to Pyrifluquinazon was absolutely dependent on the presence of $Ca^{2+}$ in the extracellular media (FIG. 4A).

Second, stimulation of the insect TRPV channel was inhibited by cell-impermeable ion channel blocker, Ruthenium red (FIG. 4B).

Third, in parallel experiments we measured the response using either $Ca^{2+}$ probe FLUO4, or proprietary membrane potential kit (Molecular Devices), which utilizes cell-impermeable component. As evidenced by FIGS. 4C and 4D, both methods produced similar time- and dose-dependence curves.

Example IV

To confirm selectivity of the observed response, both pymetrozine and metabolite B of pyrifluquinazon were tested against TRPV4 channel, which is a close mammalian homologue of Iav and Nan. TRPV4 can be activated by several agonists, including GSK1016790A (Thorneloe et al., 2008).

Figure 5B:
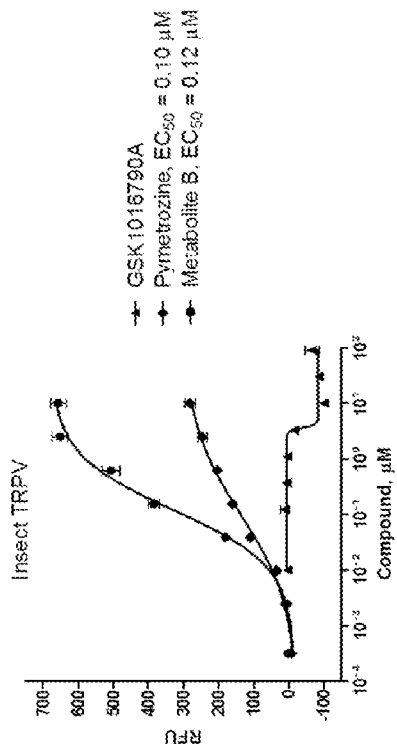
FIG. 5B depicts a graph showing activation of insect TRPV channel by pymetrozine and pyrifluquinazon metabolite B, but no mammalian TRPV4 agonist, GSK1016790A.
Figure 5C:
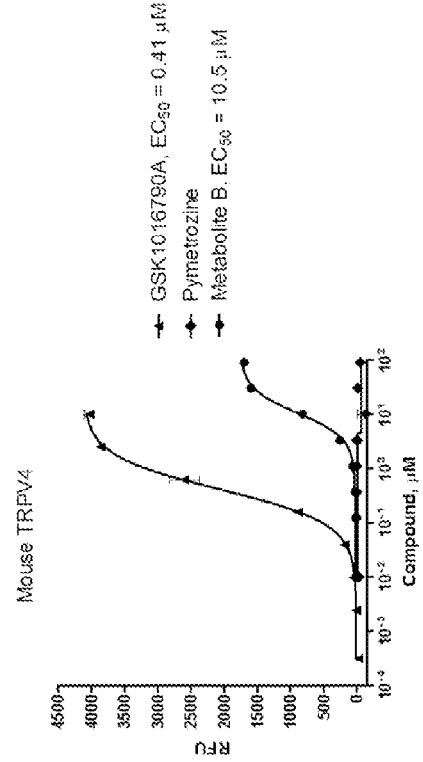
FIG. 5C depicts a graph illustrating strong activation of mTRPV4 channel by known TRPV4 agonist, GSK1016790A and a weak activation by pyrifluquinazon metabolite B, but not by pymetrozine.
Figure 5A:
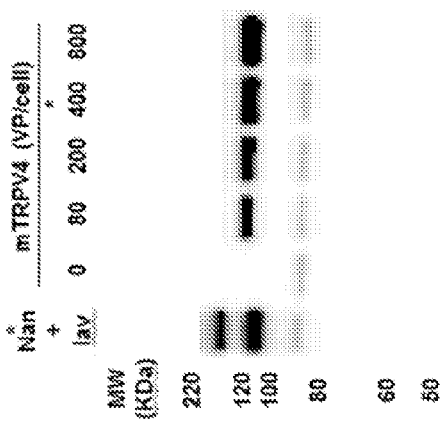
FIG. 5A depicts a photograph of a Western blot showing equalization of mTRPV channel expression levels with the optimal levels on Nan and Jay expression levels as detected by an antibody to a common AcGFP1 moiety.

As different adenovirus constructs can produce different levels of expression, Western blotting with antibody to the common AcGFP moiety was used to equalize expression of mTRPV4 with that of Nan and Iav (FIG. 5A).

As evidenced by FIG. 5B, both Pymetrozine and metabolite B of Pyrifluquinazon, but not GSK1016790A, triggered $Ca^{2+}$ mobilization in the cells expressing insect TRPV channels.

In contrast, in the cells expressing mTRPV4, GSK1016790A induced strong $Ca^{2+}$ mobilization response, whereas Pymetrozine had no effect (FIG. 5C). Metabolite B of pyrifluquinazon did trigger $Ca^{2+}$ mobilization in the mTRPV4-expressing cells, but it was ~100 fold less potent against mouse TRPV4 than against Drosophila TRPV channel.

Example V

To test selectivity of the assay more rigorously, 19 pharmacologically active compounds provided in Table 2 with known molecular targets were chosen for testing.

The compounds were tested at single high dose (20 μM) on CHO-K1 cells expressing either insect TRPV, mTRRPV4 or parental CHO-K1 cells (Table 1).

As shown in Table 2 below, three of the tested compounds triggered response equivalent or exceeding 25% of the response observed on insect TRPV cells stimulated by the pyrifluquinazon metabolite B. However, these three compounds triggered even stronger response in parental CHO-K1 cells, indicating that the observed effect was not related to insect TRPV channels.

As such, using combination of cells expressing insect TRPV, a related mammalian TRPV channel, and parental cells one can filter out non-specific activators, and utilize this method to screen for new modulators of the insect TRPV channel.

TABLE 2

| | | Response of cells (fluorescence units) | | |
| --- | --- | --- | --- | --- |
| Known mode of action | Compound | Insect TRPV cells | mTRPV4 cells | Parental CHO cells |
| Agonist of GABA-gated cloride channels | GABA | 68 | 43 | 100 |
| Antagonist of GABA-gated cloride channels | Dieldrin | 78 | 52 | 73 |
| Antagonist of GABA-gated cloride channels | Fipronil | 133 | 60 | 240 |
| Antagonist of GABA-gated cloride channels | Ethiprole | 154 | 113 | 357 |
| Antagonist of GABA-gated cloride channels | Lindane | 35 | 12 | 19 |
| Activator of chloride channels | Abamectin | 49 | 30 | 52 |
| Agonist of octopamine receptors | Octopamine | 66 | 20 | 45 |
| Agonist of octopamine receptors | Amitraz | 58 | 25 | 50 |
| Agonist of adrenergic receptors | Clonidine | 135 | 62 | 136 |
| Agonist of adrenergic receptors | Naphazoline | 31 | 11 | 50 |
| Agonist of adrenergic and 5HT receptors | Miansenn | 86 | 30 | 110 |
| Agonist of nicotinic acetylcholine receptors | Nicotine | 81 | 8 | 65 |
| Agonist of nicotinic acetylcholine receptors | Imidacloprid | 42 | 16 | 69 |
| Agonist of nicotinic acetylcholine receptors | Thiacloprid | 36 | 16 | 29 |
| Agonist of nicotinic acetylcholine receptors | Dinotefuran | 48 | 23 | 23 |
| Agonist of nicotinic acetylcholine receptors | Epibatidine | 70 | 63 | 49 |
| Agonist of nicotinic acetylcholine receptors | Acetylcholine | 250 | 190 | 797 |
| Modulator of ryanodine receptors | Rynaxapyr | 43 | 74 | 93 |
| Modulator of ryanodine receptors | Ryanodine | 53 | 19 | 75 |

TABLE 2-continued

| Known mode of action | Compound | Response of cells (fluorescence units) | | |
|---|---|---|---|---|
| | | Insect TRPV cells | mTRPV4 cells | Parental CHO cells |
| Agonist of TRPVA channels | GSK1016790A | 53 | 2017 | 71 |
| Modulator of insect TRPV channels | Pyrifluquinazon metabolite B | 538 | 346 | 40 |

It is therefore intended that the foregoing detailed description be regarded as illustrative rather than limiting, and that it be understood that it is the following claims, including all equivalents, that are intended to define the spirit and scope of this invention.

REFERENCES

1. Kim J, Chung Y D, Park D Y, Choi S, Shin D W, Soh H, Lee H W, Son W, Yim J, Park C S, Kernan M J, Kim C. A TRPV family ion channel required for hearing in *Drosophila*. Nature. 2003 Jul. 3; 424(6944):81-4. Epub 2003 Jun. 18. PubMed PMID: 12819662.
2. Gong Z, Son W, Chung Y D, Kim J, Shin D W, McClung C A, Lee Y, Lee H W, Chang D J, Kaang B K, Cho H, Oh U, Hirsh J, Kernan M J, Kim C Two interdependent TRPV channel subunits, inactive and Nanchung, mediate hearing in *Drosophila*. J Neurosci. 2004 Oct. 13; 24(41):9059-66. PubMed PMID: 15483124.
3. Ausborn J, Wolf H, Mader W, Kayser H. The insecticide pymetrozine selectively affects chordotonal mechanoreceptors. J Exp Biol. 2005 December; 208(Pt 23):4451-66. PubMed PMID: 16339866.
4. Thorneloe K S, Sulpizio A C, Lin Z, Figueroa D J, Clouse A K, McCafferty G P, Chendrimada T P, Lashinger E S, Gordon E, Evans L, Misajet B A, Demarini D J, Nation J H, Casillas L N, Marquis R W, Votta B J, Sheardown S A, Xu X, Brooks D P, Laping N J, Westfall T D. N-((1 S)-1-{[4-((2 S)-2-{[(2,4-dichlorophenyl)sulfonyl]amino}-3-hydroxypropanoyl)-1-piperazinyl]carbonyl}-3-methylbutyl)-1-benzothiophene-2-carboxamide (GSK1016790A), a novel and potent transient receptor potential vanilloid 4 channel agonist induces urinary bladder contraction and hyperactivity: Part I. J Pharmacol Exp Ther. 2008 August; 326(2):432-42.
5. Chang G C, Snyder W E. Pymetrozine causes a nontarget pest, the Colorado potato beetle (Coleoptera: Chrysomelidae), to leave potato plants. J Econ Entomol. 2008 February; 101(1):74-80. PubMed PMID: 18330119.
6. Peter Maienfisch. Selective Feeding Blockers: Pymetrozine, Flonicamid, and Pyrifluqulnazon. Modern Crop Protection Compounds; Wolfgang Kramer, Editor, Second Ed., chapter 33, pp 1325-1346, 2012
7. Douglas J T. Adenovirus-mediated gene delivery: an overview. Methods Mol Biol. 2004; V246:3-14. Review. PubMed PMID: 14970581.

SEQUENCE LISTING (112 sequences)

SEQ ID NO: 1 - DNA, 2502 bp, Drosophila melanogaster
atggggaatacggagagcaatgttaccagcggggtgaagaagcaggccggagtctccacccaggctctatacaagttcgtgaatctcaagggcggtggactcctggtggacatgatgaaaagagcctgtcaaaccaaacagtttgctgagatcgatcatgctatcaaaaccaaagtggagccctttctgtacaacaagggcgctggacggtattttcccatctcgaagctcgtactgctgcgaaatcgggatcgcccacgcactcgccaattgcccgagatccgagccctcgagaatcctgacgacgatttcaacatccatgactactgccccgaggtttcggaggccgagtatatctccaatcctacggcctatcgattcgtctgctgggatcttaatatgcgtggcgctgtgggcgaaactattctccatttgtgcctgctaaatgcatcttccttgcacgcagatctcgccaaaagattgctaaaattctacccgaaactcatcctggacatttacatgagcgacgagtattatggagagagtgtcctgcacattgccatcgtcaatgaagatccggcaatggtgaagtatctgctggatgccaacgcagatgttcaagagcggtgctgtggagccttcatgtcggcggaggatactaagttttctcgcacggattcgccggatcacgagtatgtggcactttgtcccatgaccaactacgatggttatgtttactggggagaatacccattgagttttgccgcttgcctgtcgcaggaggagtgcttccgcttagttttggccagaggtgccgatcccgacttccaggacaccaacggaaacaccgttctccacatgctggtcatttacgaaaagatcgaaatgttcgatgttggctacgaggttggaacaaacatacacataaaaaacattcagaatctcacgccccttactttggcggccaagttgggcagagttgagatgttcttccacgtgatgagcatcgaacgggagatctattggcaattgggtagcatcacatgtgccgcatatccgcttttgatgatagacactataaatgaggaaaccggcaatatcaacaaggactccgtgctgaactttgtggtatttggcgataagctggagcacttggagctgctagatggggtggtcatagatctgctaaagaccaaatgggacacgttctgcaaatcgcgattttacaagcaattttacatgttcgccctctactttctcatctcgctgttcagttttatactgcgtccaggtccggatgccaaggacgaagacgaggatggcgccaatagcactacggctaaaagtgatctgtataggcaaaatggatcggattcttaccatctgcacagcaagcgggctacaatgactaccgaatacaaaacattttggcttaattttactgagtactacgatccatcggaagttgaggtcctgcccgcctggtgggaaagttatgctcagtgtcctttgatgaatctcgaatccgatttggccaagcttcgtattatggcagaactgttgaattttgtaggagctatcctgtatctgctggttgctttgcgagaagctcgattcctgggccttaaaatgtttatcgaaaacttgatgacggcaccttcgcgagttatgtttctgttttcgtgtgctttgatgatgactataccctggttgagggtttcctgtctcaccgaaatagatgatcacgtcaccgttgtgataatgctaaccactgctccctattttctattcttttgtcgcggcttcaaaactgtcggtcccttcgtagtgatgatataccgcatggtcatgggagatctgctccgattcgtctccatctacttggtgttcgtcatgggtttctcccaggcattttacataatttttctaaccttcgacaacccatcgtcaccagaggatcaggacgcggaatccaacccaatgccctcgcccatggaatcgatagtggccatgttcctaatgtcgctaacaaatttcggtgactactatggagcgatggtgtctacgcagcacgaatacgaggcgaagatcctcttctttctgttcatggtgatcgtgagtgttctgctggtgaacatgttgatcgccatgatgggtaatacgtatcagaagatcgccgagatccgaaacgagtggcagcgccaatgggccaggatcgtcctcgtcgtggagcgaagtgttcctcccgccgagcggttgaagaactttatgcagtacagtcagtcgatgtcggatggcagaagggcactggtcctccggttgaatatgactgaggaaaaggaggagatgaaggaggtgcaggagatgaagcgcatccatcaacggttcgccaagaagcggcaaatggagcgcgaggctcgcgcccttcgacgtcaacaggagtacgagaagttcttcggcaccgcccccaaatcggaatgttccgataacaacaacttttga

SEQ ID NO: 2 - DNA, 2505 bp, Drosophila melanogaster
atggggaatacggagagcaatgttaccagcggggtgaagaagcaggccggagtctccacccaggctctatacaagttcgtgaatctcaagggcggtggactcctggtggacatgatgaaaagagcctgtcaaaccaaacagtttgctgagatcgatcatgctatcaaaaccaaagtggagccctttctgtacaacaagggcgctggacggtattttcccatctcgaagctcgtactgctgcgaaatcgggatcgcccacgcactcgccaattgcccgagatccgagccctcgagaatcctgacgacgatttcaacatccatgactactgccccgaggtttcggaggccgagtatatctccaatcctacggcctatcgattcgtctgctgggatcttaatatgcgtggcgctgtgggcgaaactattctccatttgtgcctgctaaatgcatcttccttgcacgcagatctcgccaaaagattgctaaaattctacccgaaactcatcctggacatttacatgagcgacgagtattatggagagagtgtcctgcacattgccatcgtcaatgaagatccggcaatggtgaagtatctgctggatgccaacgcagatgttcaagagcggtgctgtggagccttcatgtcggcggaggatactaagttttctcgcacggattcgccggatcacgagtatgtggcactttgtcccatgaccaactacgatggttatgtttactggggagaatacccattgagttttgccgcttgcctgtcgcaggaggagtgcttccgcttagttttggccagaggtgccgatcccgacttccaggacaccaacggaaacaccgttctccacatgctggtcatttacgaaaagatcgaaatgttcgatgttggctacgaggttggaacaaacatacacataaaaaacattcagaatctcacgccccttactttggcggccaagttgggcagagttgagatgttcttccacgtgatgagcatcgaacgggagatctattggcaattgggtagcatcacatgtgccgcatatccgcttttgatgatagacactataaatgaggaaaccggcaatatcaacaaggactccgtgctgaactttgtggtatttggcgataagctggagcacttggagctgctagatggggtggtcatagatctgctaaagaccaaatgggacacgttctgcaaatcgcgattttacaagcaattttacatgttcgccctctactttctcatctcgctgttcagttttatactgcgtccaggtccggatgccaaggacgaagacgaggatggcgccaatagcactacggctaaaagtgatctgtataggcaaaatggatcggattcttaccatctgcacagcaagcgggctacaatgactaccgaatacaaaacattttggcttaattttactgagtactacgatccatcggaagttgaggtcctgcccgcctggtgggaaagttatgctcagtgtcctttgatgaatctcgaatccgatttggccaagcttcgtattatggcagaactgttgaattttgtaggagctatcctgtatctgctggttgctttgcgagaagctcgattcctgggccttaaaatgtttatcgaaaacttgatgacggcaccttcgcgagttatgtttctgttttcgtgtgctttgatgatgactataccctggttgagggtttcctgtctcaccgaaatagatgatcacgtcaccgttgtgataatgctaaccactgctccctattttctattcttttgtcgcggcttcaaaactgtcggtcccttcgtagtgatgatataccgcatggtcatgggagatctgctccgattcgtctccatctacttggtgttcgtcatgggtttctcccaggcattttacataatttttctaaccttcgacaacccatcgtcaccagaggatcaggacgcggaatccaacccaatgccctcgcccatggaatcgatagtggccatgttcctaatgtcgctaacaaatttcggtgactactatggagcgatggtgtctacgcagcacgaatacgaggcgaagatcctcttctttctgttcatggtgatcgtgagtgttctgctggtgaacatgttgatcgccatgatgggtaatacgtatcagaagatcgccgagatccgaaacgagtggcagcgccaatgggccaggatcgtcctcgtcgtggagcgaagtgttcctcccgccgagcggttgaagaactttatgcagtacagtcagtcgatgtcggatggcagaagggcactggtcctccggttgaatatgactgaggaggaaaaggaggagatgaaggaggtgcaggagatgaagcgcatccatcaacggttcgccaagaagcggcaaatggagcgcgaggctcgcgcccttcgacgtcaacaggagtacgagaagttcttcggcaccgcccccaaatcggaatgttccgataacaacaacttttga

SEQ ID NO: 3 - DNA, 2517 bp, Musca domestica
atgggaaatactgaaagtaatgttaccagtggtgtcaagaaacaggcgggagtttccacccaggccctgtacaaatttgtcaatctaaagggtggtggccttctggtggacatgatgaaaagggcctgtcaaacgaaacaattcgccgaaatagatcatgccattaaaaccaaggtggaaccatttctctataacaaaggagctggtcgttattttccgatttcgaaaatggttttgttacgcaacaaggagagggcacgcacgaaacaactgcctgaaatacgggcccttgaaaatcccgatgaagatttcaatattcacgactactgttccgaggtgtcggaggcggagtacatatccaatccgagtgcctatcgttttgtttgttggaatttgaatgaaagaggtgctgtgggtgaaacaattctacacttgtgcctgctcaatgcctcctcgttgcatgcggatttggccaagaggctattgaaattttatcccaaactcattatggatatttacttgagcgatgaatactatggagaatcggtgttacacattgccattgtgaacgaggatccggcaatggtgaaatatctattggatgccaatgccgatgtccaggagagatgctgtggtgcctttatgtcggccgaagatcaaaaggcttcgcgatatgactcccccgaacatgaatatgttggtgttcatcccatgaccaattatgatggctacgtttattggggtgaatatccactgtcatttgcagcctgtttatcgcaggaagaatgttttcgtttggtgttggcccgtggtgctgatcccgatagccaagataccaatggcaataccgtgttgcatatgttggtgatctatgagaaaatcgacatgttcgatgtggcctatgaggttggcaccaatatccacatacggaatgtacaaaatcttacacccctgacattggcggccaagttggcgcgggtggaaatgtttttccacattttgagtatagagagggaaatttactggcagttgggtagcataacatgtgccgcatatcctttgtcaaaaatcgataccattgatgttaagactgggaatataaacaaggattcggtgttgaattttgtggtgtttggggacaaattggaacatttggagttgttggatggcgtggtcattgatttgcttaaaacgaaatgggaaacatttgtcaagtcccgtttctacaaacagttttatatgttttccttctatttcctcttctccttggtgagttttatatcccggccaggacccaaaattgaggatgaagatgaggagggggatgcgaatgattcggcgggtaaaggaaatgattctaccacaaatgccagacttttgtatgccacacctgccagtagagtaacaggcattgaaaagttaccctacaaaacattttggcttaactttagtgagtacattgatgatgatgctaatgctgaaaatatgccctcctggtgggcaagctatgaggagtgtcccctgatggatatggaaacgaatttggcaaagttccgcattgtgtccgaaatcgtaattttctttggagcgattttgtatttgttatcggccctgagagaggccaagtttttgggttataaaatgtttgttgaaaatctgatgacggcaccctcaagggtcatgttcttgttctcctgctgcctaatgatgaccataccctggctaaggctatcctgtctcaccgaactggatgatcatgtggcggtgatgataatgcttaccacggctccctactttttgttcttttgtcgaggcttcaagaccgttggtcccttcgttgtgatgatctatcgcatggttatgggagatttgatacgtttcgtatcgatttatttggtctttgtgatgggcttttcccaggcctattacattatctttttgaccttcgataatcctgccacaccggaggaaattgatgataccggcacaaatcccatgccatcgcccatggaatcagtggtggccatgtttctaatgtccctgacaaatttcggtgattattacggggccatgggttcgacgcaacatgaatatgaagcgaaaattttattcttcctttttatggtgatcgtcagtgtgttgctggttaacatgttgattgccatgatgggtaatacgtatcagaagattgccgagatacgcaatgaatggcagcgccaatgggcccgcattgttttggttgtggaacgtagtgtgccaccggcagagcgtttgaagaatttcatgcagtattcacaaccgatgtcggatggacgcagggctttggtgttgcgtttaaatatgagtgatgaggacaaagaggaaatgaaagaggtgcaggaaatgaaacgcatacatcaacgcttttccaagaaacgccaaatggagcgggaggccagagccaaaaagcgccaggaggaatatgagaaattctttggcgcaacaccaacgtccgataatgaaaataataatttctaa

SEQ ID NO: 4 - DNA, 2535 bp, Ceratitis capitata
atggggaataccgagagcaatgttaccagcggcgttaagaaacaagctggcgtctccacgcaagcactctacaaattcgttaatctcaaaggcggcggcctgctggtggacatgatgaagcgcgcttgtcagacaaagcagtttgcagagatcgatcatgccattaagacgaaggtggaaccttttctctacaataaaggcgctggtcgctactttcccatatcgaagttggtgctgttgcgtaataaagagcgtgcgcgtaccaagcagctgcctgagattagagcaatggagaatcccgatgaagattttaatatacacgatcattgtaccgaggtttcggaggctgagtacatatcgaatccgagtgcttatcgttatgtttgctggaatttgaatgaacgtggcgctgtcggtgagactatcttgcatctctgtctgttgaatgcctcatcgctgcatgccgatctggcgaaacgtctgctcaagttttatcccaaactcatactggatgtgtatatgtgtgatgagtattatggtgagagcgttttgcatatcgcgatcgttaacgaagatccagcaatggttaagtatctgctcgacgcaggcgctgatgtgcaagaacgctgctgtggcgccttcatgtccgcggaggatcagaaagcatcacgctacgactcacccgatcatgaatatgtcggcgtacaaccgatgaccaactatgatggctacgtttattggggcgagtatccgatgagttttgctgcttgtctctcgcaagaagactgttttcgtttggtattggcgcgcggcgctgatccgaatctgcaggacaccaacggtaatacctcgctgcatatgttggtgatctatgaaaagatcgaaatgttcgatgtggcctacgaggtgggtactaatatacatttgcgtaatgtacaaaacctgacagctttgacgttggcggcgaaattgggtcgcgtcgagatgttctttcacatattgagtattgaacgcgagatctactggcagttgggtagcataacgtgtgcggcatatccactctcgatgatcgacacaatcgatgtggagacgggtaatatcaataaggactcggttttgaattttgtcgtgtttggtgacaaactggagcacttggagctgctggatggcgtagtgatcgatttgttgaagaccaaatgggagtccttcgtcaagtcgcgtttctacaagcagttttatatgttctccttctattttctcttctcattaatcagtttcatctcgcgaccaggaccgactgaaaagaatgaggacgatgatgatgatgatgatgctgatgctagcgttgaggctaccgtaacgcgcgcagcgaatagtacggctccgctacaacgtggcgatcagtggttcaagcgcttgatcaagcgtgctatcgacaagatggaatacaaaaccttttggctgaacttcacagactactttgatgacaacgacgtggaatcggtgccaccgtggtgggcgagctatgccgagtgcccgcttatgaacatggaatcggacttagcgaagctacgcattgtggcggaaataattatattttttggctcggttctatatttattcgccgcgctgagagaggcacgctttctgggctataaaatgtttgtcgaaaatatgatgaccgcaccttcgcgtgtcatgtttcttttctcttgcgcactgatgatgtctataccttggctgagggtgttttgtctgactgagatcgatgaccacgtggcggtatttattatgcttacaacagcaccctattttctgttcttctgtcgcggcttcaaaactgtcggtcccttcgttgtgatgatctatcgcatggtcatgggtgatcttatacgttttgtctccatttatttggtttttgtaatgggtttctcgcaagcttactatattatttttctcacctttgacaatcccgctacaccggaggaaatcgatgactccgagtcgaatccaatgccctcaccaatggagtctatcgttgcaatgtttctgatgtcactcacgaatttcggtgactatttcggcggcatggcctcgacacagcatgaatatgaagcgaagacactcttctttctcttcatggtaatcgtcagtgtgttgttggtgaacatgttgatcgccatgatgggtaatacctatcagaagattgccgaaatacgcaacgaatggcaacgtcagtgggcgcgtatagttttggtggtggagcgcagtgtaccaccagcggagcggctcaagaacttcatgcactacagtcaaccaatgtcggacggcaggcgtgcgttggtgttgcgtttaaatatgagcgatgaagttaaggaggaaatgaaggaggtacaagagaccaaacgcatacatcagcgcttctcgaagaaacgacaaattgagcgcgaggcgagagcacaaaagagacaagaggagtatgagaaattctttggcaagaagccgtcgggcaacagtgataacaataatgcctaa

SEQ ID NO: 5 - DNA, 2502 bp, Anopheles gambiae
atgggaaataccgagagcaatgtgaccagtggcgttaagaagcaggctggagtgtccacccaggcgctgtacaagttcgtcaacctgaagggcggcggcctgctggtggacatgatgaagcgcgcgatacagaacaagcagtacgccgagattgatcatgcgatcaagacgaaggtggaaccgtttctgtacaacaagggcaaggggaagtacatccccgtgtcggtgctggtgctgttacgaaaccgggagcggccgcgccacaagcagctgcccgagatccgggcgatggagaacccggaggaggactttgacatcgatgcggtctgtccggaagtgagcgaagccgagtactacctaaacccgtccggctatcgggaggtgtgctggaacataaaggaacgtggcgctgtgggagagacaattctacacctttgcctactgaacgccacttccctgcatgcggatctagccaaacgactgctgcgcttctatcccaagctcatcaacgacgtgtacatgtgcgacgagtactacggtgagaatgtcctgcatctcgcaatcgtgaacgaagatcctgccatggtgaagtatctgctcgatcacaacgcggacgtaaacgagcgctgctgcggtacgttcatgtgcccggaagaccagaaagcctcccgctacgatacgcccgaaacggaggtcgtccagatggtgcaggtgacgaactacgacggctacgtgtactggggcgagtacccgctcacctttgccgcctgtctcgggcaggaggagtgctaccggctggtgctggcccgcggcgccgacccggacaacaaagacttcaacggcaacacggtgctgcacatgctggtgatatacgagaagattgccacgttcgacatggggtacgaggtgggttcgtcgcttagcatccgcaaccaccagaacctgacgccgctgacgctggcggccaagctcggccgggtggagatgttctttcacatcatgaacatcgagcgcgagatctactggcagctgggcagcatcacgtgcgcggcctatccgctcggcctgatcgacacgatcgacgtggagacgggaaacattaacaaagattccgccctcaatctggtggcgttcggcgacaaggacgagcatctcgatctgctagacggggtgctgatcgatctgctcaagacgaagtggaacacgttcgtgaaggacaagttctatcggcagtttttcatgttcttctgctacttttgcgtgtcgctggtgagcttcacgctgcgcaatggaccaccaccggcggaggatgacgatgggaaggagagcgaggctggggggaataaaacggcagctgtcacgaaggaagagcttcgtcggcagctgtggaacgaaacgacgctagaggatgcgctggctgcgcttgccggcaatggaagcttcgctggacggttgtcgaatctggagcagagcaacggaagtagcgacgcgatgggtgagtttgatcctgccgagatggacgacgagggtctgttcttcaactccaactgtcacacgatggattacgacggtgtggagggcaaggtgcgtctcatatcggagatgatcatactggtcggttcgtttctgtatctgctcgctgccttgcgggagttgaagtttcttgggcggaaaatgttcttcgaaaatcttatgacagcaccatcgagggttatgtttctgttttcctgctgcataatgatgatcgtaccgtttctgaaggttctctgctttacggagctggaagatcacgtagccgtaacgatcatgctgacgacggcgccctattttttattcttctgtcgtggcttcaaaacggtcggaccgttcgtggtgatgatataccgcatggtgatgggcgatctgttgcggttcgtcgtcatctatctggtatttgtgatgggcttctcgcaggcgtactacattgtgtttttgtcctacaaaccggacgaggaaggcgacccaaacccgatgccgtcgccgatcgagtcgatcgtagcgatgtttctgatgtcgctgaccaactttggcgattactatggcgcactggagaacaccgaccacgagatgtgcgcaaagatcttgttcgtgctgttcatggtgatcgttgccgtgctgttggtgaacatgttgatcgctatgatgggcaacacgtaccagaagattgcagaaacgaagaacgagtggcagcgccagtgggcccgcatcgtgctcgtcgtcgagcgtggcgtcccaccaaaggagcggctcaagaacctgatgtcgtacagccaaccgatgtcggacgggcgtcgtgcgctggtgctacgattaaacatgacggaagataaggaagagatgaaggagatactcgaaatgaagcgcgtccacgagcggctctctataaagcggcagatcgagcgggatgcacgggccgagcagcgtcggctgctgcgcgagaagtacttgaatatgtcttcatga

SEQ ID NO: 6 - DNA, 2448 bp, Aedes aegypti
atgggaaataccgagagcaatgtcaccagcggagtcaagaaacaggccggagtgtccacccaggctctgtacaagttcgtcaatctgaagggtggtggtcttttggtggacatgatgaaaagagcaatccaaaacaaacaatatgcagaaatagatcatgcgatcaaaacgaaagtcgaacccttcctgtacaataagggcaaagggaagtatatcccagtggcccagttggtgctgctgaggaatcgagaacgacctcgatccaagcagttgccagagattcgtgccttggaaaaccctgaagaggatttcgacattgacgcagtatgtccggacgtgaccgagggcgaataccagaggaatccatcggggtacagggaggtgtgctggaacatcaaggaacgaggagcagtcggcgaaactattcttcatctgtgcttgctgaacgcaacatctttgcatgctgatcttgccaagcgcctactacgtttctacccgaagctcatcaacgatatctacatgtgcgatgagtattacggggaaagtgtgctccacgtggcaattgtcaacgaagatccggccatggttaagtatttattggacagtggttccgatgtagacgagagatgttgcggaacgttcatgtgtccagaggaccaaaaggcaacgcgatacgattctatcgaaacggaaatcatttgcgtacttcccatgaccaactacgatgggtatgtgtattggggcgaatatccgttgagttttgccgcttgcttaggccaggaggaatgctaccggttggtgttggctcggggagctgatccagataatcaggattcgaacggaaacaccgttttgcacatgttggtcatctacgagaaaatctcaacattcgacatggcgtatgaagtcggctcatcgctggacataagaaacctgcagaatttgacgccgttgactttggcagccaagttgggtcgggttgagatgtttttccacattatgaacatcgaacgagaaatctactggcagttgggagctatcacttgtgcagcctatccgcttgctttgatcgacacgatcgacatcgaaacagggaacattaacaaagattcagcattaaatttagtggtattcggcgacaaagcggagcatttagacctactagaaggtgtactgattgatttgctcaagaccaagtggaactcgttcgtcaaagacaagttctatcgccaattcttcgtgttcttttggtatttttgcgtttcactagtaagcttcactctgagaaggggaccaatgaatttggaggagacggcagccaaccgcaccacaaccagcattactttgaaaaatttgacattttctgattcgactaacgcaacattacccactttactggctgcggatgtgaacgaaaaaatcgttcaatttattgcaaacgaaacgttattcgatccggcagttatggaagaaaacactttctttaattctaaatgtgccaccatggcatacgacacactgcaggataagataaggttggtttcggagatcatcattctcatcggatcattcttgtacctagttggagcgttgagagaatttcgattcttgggacgaaaaatgttctttgagaatttgatgatttccccttctcgagttatgtttctgttctcgtgctgcataatgatgatcgtaccgtttctgaaagtcctttgcttaatcgagcttgaggatcacgttgccgtgacgattatgttgactactgctccgtactttttgttcttctgtcgtggtttcaaaaccgttggaccgttcgttgtgatgatctaccgcatggtgatgggagacttgctgcgattcgtcgtcatctatctggtgttcgtgatgggattttcccaggcctactacattgtgttcttgtcgttcaagggtgaagaggaaggcgatgaaaacccgatgccttcgccgatggagtcgatagtggcgatgtttttgatgtcgctgacgaatttcggcgactactacggtgcactggagaaaaccgagcacgagggatgcgctaaggttcttttcgtcattttcatggttattgtggccgtcctgttggtcaacttgctcatcgccatgatgggtaacacctacaccatgattgccgaaacgaagaacgaatggcaacggcaatgggcacgaatcgttctggtagtggaacgaggagttcctccgagcgagcgactcaaaaacttcatgagctacagccaacccatgtcggacgggagacgagccctcgtgttgcgattgcatatgacggacgaagacaaggaagagatgaaggaaatcctcgagatgaaacgtgtccatgaacgcttgaagaagaaacgtcaggtggaacgagaattaagagccgagcagcgacgactaatcatggagaaatatgcaaacgtaccttga

SEQ ID NO: 7 - DNA, 2451 bp, Culex quinquefasciatus
atgggaaataccgaaagtaacgtcaccagtggcgtcaagaagcaggccggagtgtccacccaggcactgtacaagtttgtcaacctgaaaggtggcggcctgctggtggacatgatgaagcgggcgatccaaaacaaacagtacgccgaaatagaccacgcaataaagaccaaggtggaaccgtttctgtacaacaagggcaaggggaagtacattccggtggcacagttggtgtacctaaggaaccgggaacggccacgccacaagcaactgccggaaattcgtgccctcgaaaatcccgaggaggactacgatatagacaaagagtgcccggatgtgaccgagggcgagtacatgcggaaccccggggggtacagggaggtgtgctggaacatcaaggaacgtggcgcagtaggcgagaccattttgcatttgtgccttctgaacgcaacttcactgcacgcagatctggcgaagcgcctgctgcgattctaccctaaactgattaacgatgtgtacatgtgcgatgagtactacggcgaaagtgtgctgcatttggcgatcgtcaacgaagatccggccatggtgaaatacctgctggatgccgggtccgacgtgaatgaacggtgctgcgggacgttcatgtgtccggaggatcaaaaagcatcccggttcgattcactggaaacggaaataatctgtgtgatgccacaaaccaactacgacggatacgtctattggggagagtacccgttgagcttcgccgcttgtttgggccaggaagagtgctaccggttggtgttggcacggggagccgacccggataaccaggattcaaacatgaacaacgttctacacatgatggtgatttacgaaaagttaacgacgttcgacatggcgtacgaagtgggttcttcgctgagcataagaaatctccaaaatctaacaccgttgacgttggccgccaagctgggtcgcgtcgaaatgttcttccacatcatgaacattgagcgggagatctactggcaattgggaagtattacgtgtgccgcctacccgctggcattgctcgataccatcgacatcgaaaccggcaacattagcaaagattccgcgctgaatctggtcgttttcggcgacaaagacgagcatttagatctcctcgaaggagtcctcatcgatctcctgaaaaccaaatggaacacgttcgtcaaggacaagttctacagccaatttttcgtgttcttttgctatttttgtgtgtcactgattagcttcacactgcgcgagggaccaatgaagctagaggacggagaggccaacaaaactaccacgagtattcagctaaaaaatatgaccctggccgacctcaccaacgccagtacgctgtcctcgctactggtcaccgacgtgagcggcaagatcgtcggactcaacgggagtgaaacgttcttcgacccgtcgacgatcgagtccgacatgttcttcaactccaagtgtccaacgatgatctacaagggtatcgaggggaaaattcgactggtttcggaagcaattattctggtgggatcatttctctatctggtttcggctttgagagaatctcgctttcttgggaggaaaatgtttatcgaaaatttgatgaccgctccttccagagtaatgttcctgttttcctgctgtatcatgatggtagttccttgcctcaaagtgctatgtttcaccgagttggaagatcacgttgcggtcgtgattatgctgacaactgcgccctacttcctgttcttctgtcgcggcttcaaaacggtcggaccgttcgtggtgatgatttaccgcatggtgatgggagatctgctccggttcgtggccatttactcggtgttcgtgatgggcttctcccaggcctactacatcgcgttcctgtcgtacaagggcgaggaggagggcgacgagaatccgatgccctcgccgatggagtcgatcgtggccatgtttctgatgtcgttgaccaactttggcgattactacgccgcgctcgaggataccgcccacgagggttgcgcaaaggtactctttgtgacatacatggtaattgtggcggtgctgttggtcaacttgctgatcgctatgatgggtaatacgtacaccaagattgccgagacgaaaaacgagtggcaacggcagtgggctcgcatcgttctggtcgtcgagcgaggcgttccaccggcagaacgtctgaagaacctaatgaactacagtcaacccatgtcggacggtagaagggccttggttttgcgattgaatatgacggaagaggataaggaagagatgaaggagatccttgacatgaaacgggtgcacgaacggctgtccaagaagcgagcagttgagcgggaagcacgcgccgagcagagacgtctcattgcggagaaatacgcaaacgtaccgtag

SEQ ID NO: 8 - DNA, 2385 bp, Tribolium castaneum
atgggtaataccgaaagtaacgttactagtggtgttaagaagcaagctggtgcttcagtgcaaccaatttataaattatgcgatttgaaagggggagggctcctagtggaattaatgaaacgggccacacaaaacaagcaatatgcagaactagaccacgcaataaaaaccaaggtggagcactttttgtacaataaaggggctggacggtatttcacaatatcggacttggttcttttgaggaataaggaaaggtctcgccagaaatggttaccacaattgaaagcaatggaaaaccctgaagattttgaaattgatgatgaaggccccgaaataacagaagaacagtatcaaaaaaatccgcatttgtaccgtcacgtttgctggaaaatcaaggaacgcggagccgtgggcgaaagcataatgcacttgtgtttgctaaatgccacttccttgcacgctgatatcgcaaagaggcttttacgcttttaccccaaattgattaacgatatttacatgtcggatgaatattacggagaaaacgttttgcacattgctatcgtaaacgaggatccgtcaatggtaaaattccttctagattcgggtgtaaatatccaagaacgctgctgtggcaactttatgtgtcccgaagatcagaaatcgtctcgttatgactccttggaccacgagtgggtcaacgtttgcccggtcacgaattacgaaggctatgtatactggggcgaatatcctctaactttcgccgcgtgtttaggacaggaagagagctttcgcttgatgctgtccaggggggctgatcccgatgctcaagacaccaacgggaacacggtcctacacttgcttgtcattttgcagaaattggaggctttcgatatggcctacgaagtgggggccaaattatcaatccgaaacgtgttgagtctgactccactaactctggccgcaaaacttgccagaatcgatatgtttttccacattttgaacttggaacgcgaaatttattggcaaattggcagcatcacgtgcgctgcttaccctctatcgcagattgatacaattgacattgaaacgggccaaataagcaaaacttcagcccttaatcttgtggtgtttggtgacaaagacgagcacttggagttgatggacggtgttttgatcgacttgcttaatgcgaaatggaacacttttgtcaagtttaaattctacaaacagtttttcacgtttgcgttctattttttgatctcccttgttgctttcacgctacggccagggcccccacacaaggaggccaaactggtgaatgtcacaataaacgccactgtttcaaatacttccaagtgggaaaatctcacttctataccgttcggtaaaaccccggatgatgatgacagcgacatggaagaatggtgggacaatttgcaagaagaatgtcgcttgatgcaactagaatcacccgaatctaaaattcgactcactgcagaggttttgatggttgtgggggcttttgcatatctggcagccgcagttcgcgaggctaggtttttaggggggcgcatgtttttcgaaaatcttatgactgcaccgtcaagagtcatgtttttattttcttgtattttaatgttaacggtgccatgtttgagactggcttgtttggatgagtttgaagatattgtagctgtggtgattatgttgaccactgcaccgtattttctcttcttctgtcgaggttttaaaacagtgggacccttcgttgtgatgatctacaggatggtgatgggtgatttgataagatttgcttcaatttatctagtgtttgtcatggggttttctcaagctttttacatcatttttctctcgtttgataacccactaacccctgacgacgttgacgattccgcaactaaccccatctccacccccatcgagtcaattatggcgatgtttctgatgtcaatgaccaatttcggtgactattatgcggccttcgaaaaaactgaccatgaatacgaagctaaaatgttgtttgttgtatttatggtaatcgtttcaattttactgatcaacatgttgattgccatgatgggcaacacttaccaaaaaatcgcagagacaagaaacgagtggcaaagacaatgggcgcgaattgttttggttgttgaaaggggggtgagtccctctgagcgtttgaaacaacttatggtttattcacaacctatgtccgatggaagaagggctttagtgttgagattaaaccagtctgacgaggacaaggaggaaatgaaggaaattctagaaatgcggcgcaggcatgaaagacacataaagaaaagaagcgaaaagttgaaagagaatgcaaaaaagaattga

SEQ ID NO: 9 - DNA, 2526 bp, Bombyx mori
atgggtaacacagagagtaatgtgacgagcggtgtgaagaagcaagctgggacgtcagagcaaaagctttacaaactagtcgatataaaaggaggaggtctcctggtggacatgatgaagcgagctctgcagaacaagcaatacgccgagatagatcacgctatcaagactaaagttgagccgtttttgtataatagagggaggggtcgatatataccgatatcccatctcgtcttgctcaggaacaaagagagaccgagacacaaactgctgcctccactcagaggcatggaaaaccctgacgaggaatttgacgtggataaggactggccagttgttactcaagaggaatatgacgctaatccctccggatacagggaactttgttgggatgtcaaagagagaggtgcagtgggtgagactattctgcacttgtgtctgctcaatgcgacttcgctcctagctcatctcgctaaaagactactacgcttttatcctaaaatgattaatgatatttatatcagcgatgaatactatggtgaaactgtattacatattacaatagtcaacgaagatccgacaatggcaaagtttctactggacgcgggtgcggattaccacgagcgttgctacgggaacttcatgtgtcctgaggatcaaaaggcttccaggacggactctttcgatcacgaatgggtcaacgtccagcctgacactaattataatgggtacgtctactggggcgagtacccgttgagtttcgcagcatgcttaggccaggaggagtgctaccgtttgatcttagcacgaggagcggatcctgataagcaggatactaatggcaatacagttctgcacatgctagtcatatacgagaagatgagcacattcgatatggcttacgaagtgggcgcgtccctaaacattcgtaacgtacaaaacctaactcccctaacccttgccgccaagctagctcgcaccgagatgttctttcacattctaaacatcgaaagggagatttactggcagatcggcgccaccacatgcgccgcctaccctttaggacaagttgatacaatagacactgaaacaggactaattagtaaggattcagctctgaatttggttgtttttggggaaaaagatgagcatttaggtctactagaaggtatgctgatagacttattgaaaacgaaatggaacacgttcgttaagtttcgtttctacaggcagttcatattattttcatgttacttcttggtttcactgatctgcttcacattgagaccaggaccaccggacagagcattgaatacaactgtcttgaactcaactattggtccaaacgttaccgacgccgagctggtatcggatgtcgaaaattgcacaatgaccccgaacgcagattttgatacgaatgctgttgaagtcctgaacggtactaagttcggcggttctcattgtgcacgattcaaaagtcaccccaaagaaaaatcgactgaagcacccagggagaatgacgttgaaggttggtgggaagacttgacagaggaatgcaggttgatgaacttggacacgtggcaagccaaactaaggatatctgcagagcttctgttgtggatgggggctttggcttatttcggagctgcgttacgtgaagcaaagttcctcgggatcaaaatgtttatagagaatctgagcactgtgccatccagggtgatgttcttgttttcgtgtctgctgatgttgatactgccaactttgaggttatggtgcgctgacgaggcggaggaccatctcgctgtcatgatcatgctcactactgctccttacttcttgttcttttgcaggggtttcaaaacagtgggtccattcgtggtcatgatataccgcatggtgatgggtgacctgctacgtttcgtttgtatatatttggtattcgttatgggattctcacaagcgtactacgttatattcttatcattcgacaatcccaacacgcctgaaggcgttgatgactcggtgtccaacccaatgccctcccccatggagagcatcatggcgatgttcctaatgtctctaacgtcgttctcagattactataccgcgttcgatcgcaccgaccacgaaatagaggcaaagctcctcttcgtgatatatatgataatagtagcgattctcctggtgaacatgttgattgccatgatggggaacacttaccagaagatagcggagacgaggaacgaatggcagcggcagtgggcccggatagtgctggtggtggagcgaggagttccaccggcgcagagattaaagcagctgatgacgtacagtcagcctatggccaatggaaagagagctttagtcttgagaatcaatcaaaaggacgaagacaaggaagagatgaaagagattttggaaatgaagagaactcacgagcgcattgtagctaagaggaagcaacgggaggcgcttaagcctggcgagatcccgccacccgccagagattatcctattaggaaatga

SEQ ID NO: 10 - DNA, 2379 bp, Anopheles darlingi
atgggaaatacggagagtaatgtgaccagtggcgtgaagaagcaggccggagtgtccacccaggccctgtacaagttcgtcaacctgaagggcggtgggctgctggtggatatgatgaaacgggcgatccagaacaagcagtacgccgagattgaccacgcgatcaagacgaaggtcgaacccttcctgtacaacaaaggcaaaggaaagtacatcccggtgtcggtgctggtgctgttgcgaaacagtgagcgaccgaggcacaagcagctgcccgaaatccgagcgttggagaacccggaggaggactttgatatcgatgcagtctgcccggaagtgagcgaagcggagtactacctcaacccatccgggtaccgggaggtgtgctggaacgtcaaggaacgtggagcagtcggtgagacgattctgcatctttgcctgctcaacgctacgtcactacatgccgatctggcgaagcggcttctacgcttctatccaaagctcatcaacgacgtgtacatgtgcgacgagtactacggcgagagtgttctccatctggccatcgtaaacgaggatcccgcgatggtgaaatacctgctcgatcacaactcggacgtaaacgagcgctgctgcgggacgttcatgtgcccggaggatcaaaaggcttcccgctacgatactcccgagacggaagtcgtccagatggtgcagctcacgaactacgatgggtacgtgtattggggcgagtatccccttacatttgccgcctgtctaggacaagaagagtgctaccggctggtgttggcccgcggtgccgacccggacaacaaggactttaacggcaacacggtactgcatatgctggtgatatacgagaagattaccacgttcgatatgggctacgaggtaggatcatcgttaagcatacggaatcaccagaatctaacgccgctaacgttggcggcgaagcttggccgcgtcgagatgttcttccacattatgaacattgagcgagagatttactggcagctgggtagcattacctgtgccgcctatccgctcgtcctgatcgacacgatcgacgtagaaaccggtaacatcagcaaagactcggccctgaatttggtcgtgtttggtgacaaagatgagcatctggatctactggacggtgtgctgatcgatctgctcaagacgaagtggaacacgttcgtgaaggacaaattctatcgacagttcttcatgtttttctgctacttctgtgtttcgctgatcggcttcacgctacgcaatggaccaccaccgcccgaggaagacgacgaaaatcgtgccggtggtggcagtggcaacaaaacgtcctcagcttcgaagcaggatcttcggcaacgattatggaaccgaacggtaacattagaggacgcggacaatgtaagcagccttttaagtgacattatggggattgatgcgcttggcaaactggccgagcagcttcttaacggaagcgaaggatcgggtgcattcaaacccgaaacggtcgaagaggaagaggatgggctgttcttcaactccaagtgtcacaccatggattatgatggcgttgagggaaaggtacgattcgtggccgaagtcatcatactgatcggttccttcctctatctcctgtcggcgttgcgcgagctaaagtttcttggccggaagatgttcttcgaaaatttggtaagccgtggcttcaagacggtcggtcctttcgtggtgatgatctaccgtatggtgatgggtgatctgctgcggttcgtcgtcatctatctggtgtttgtgatgggtttctcgcaggcgtactatatcgtgtttctctcctacaaaccggaggaggacggtgacgccaatccgatgccatcgcccatcgaatcgatcgtcgccatgtttctgatgtcgctgaccaactttggggattactatggagcgctcgaaaacacggatcacgagatgtgcgccaagatcctgttcgtgctctttatggtgattgtggcggtgctgttggtgaacatgctgatcgctatgatgggtaacacctaccagaagatcgccgaaaccaagaacgaatggcaacgccagtgggcacgcatcgtgctggtggtagaacgtggtgtgccaccgaaggagcggctcaaaaatctcatgtcctacagtcaaccgatgtcggatggtcggcgagcactggtgctccggttaaacatgacggacgaagacaaagaggaaatgaaggagatcctcgagatgaaacgtgttcacgagcggctgtcgaagaagcggcaggtcgagcgggatgcccgggccgagcagcgacgtttgctgcgcgaaaaatatctcaacatgacgtag

SEQ ID NO: 11 - DNA, 2703 bp, Acyrthosiphon pisum
atgggtaacaccgagagcaatgtggccagtggtgtcaagaagcaagtcgacacctcgtcactgcagatatacaaccttgtcgacctgaaaggttgtggtcttctcgtggatttgatgaagaaagccgtgcagacgaaaaattttaccgagctggacaacgcgatcaaaacccaagtggaacccatgctgtacaacaaaggtgaaggtagaatgatacctatcgccaaactcgtgttgctgagaaatcgcgaccgttcccgggcaagatggcttccaccgctaaagaacatggaagacaccaatgattacgacatagaaaaagacattcccaccattgaagaactggaaaagctgggggaagtgcagtacagggaagtgtgctgggatctgaaggaaagaggcaccgtcggcgaaacggcgttacatctatgtttgctgaacgctacgtcaatacacgcagacttggccaaaaggctgttgcatttctatccaaagctcgtaaatgacatttacatgattgacgagtattacggagagagcgttttgcacatggccatcgtcaacgaagatccggccatggtgaaggtactgatggacagcggggctaacctcaacgaacggtgtttcgggaacttcatgagcactgaagatcaaaaggcttctagatcggattcgctcgaccacgaatgggtgaacctatgtcccgacaccaattatgaagggtacgtgtattggggcgaatatccactgtcatttgcagcgtgtctcggccaagaggagagctaccgtttgatgttggcgagaggcgctgacccaaataaccaggacaccaacggcaacacggttctgcatatgcttgtaatttacgaaaaaatttcgacgttcgacatggcctacgaaattggggcggaactcaacattaggaacgtgcaaaatttgacgccactcacactggccgcgaaactggctcggatccaaatgttctttcacatactcaaaatcgaacgggaaatttattggcaaatcggcagtatcacttgtgctgcgtaccccctgacccaaatcgacaccatcgacaatgacaccgggcagatcagcagaaactcggcgctcaacttggttgtatttggcgaaagtccggaacacttggagatgatggacggtgtgttggtggatctgttaaatgccaaatggaacgctttcgtgaaattccggttctataggcagttcatcttgttcgccttttacttttccatatctatggtatgcttcgtgctgcgtcccggaccgccacccactggtcttaagccaccattaatcaactacacttccacgtcgaccacggtggccaccacgccgtttgacttcatggacaacgagtcgatgttgcccgacatgtacgacgagatgatgatcggcggtggcggtccgaccgagttcgagacggtgcaggtgaccacggaaatggcgacgaccagcgacaacgcgacgacgaccaacaacggtagcggtatcggaacgccactgatctacgaggacggcggcggtggaggtggtggaggtggtaccgtgagcttgcacgggaagagttcgggttcggacaggggcaaacacaggagcacgtggagtccggccaaccatacgttcaagaccaactacacgtacaactacaacaaatcaagaaaattttggtggaacaagagacaaaaggtatgcagattaatggctgtgcactcgactgacgatttaatcagaatgggatcggaagtgggaatgtttatgggagcattcctctatcttctggccgcggtcagagaagctggttttttgggcacacagatgttcattgaaaacttggccatagcaccggcaagagtgatgtttctgttctcgtgcctgctcatgatgaccataccgccgctgagactgacatgctatgacaaagccgaagacataatagccgtaatcattatgttgaccacttgtccgtactttttgttcttctgcaggggtttcaaaaccgtcgggccattcgtggtgatgatctataggatggtgatgggagacttgttgaggttcgtttccatttacatggtgttcgtgatgggtttctcgcaagcttattacgtgattttcctgtcttacgacaatccgctgacgccagagggtatcgatgactcggtactgaacccgatgcccacgccgaccgagtccatcatggcgatgttccttatgtccgtcaacacgttcacagactactacacggcgtttgacaagactagtcacacgttggtcgcaaagttttgctttatagttttcatggtaatcgtggccatattgctggtgaacatgttgatcgccatgatgggcaacacttatcaaaagattgccgagaccagaaacgaatggcagagacaatgggctcggatcgtactggtggtagagagaggtgtcagtccgtcgcaaaggctcataaagctcatgtactactcgcaaccgatgtcagatggccggagggcgttggtgttgcgactcaatcagacggatgaagacaaggagcaaatgaaagagatattggaaatgaaacgcattcacaatcgctatgtagaaagaatgcgcgccagagacctgagcagcaaactatcgtcttcgtgcggaaaaaatgcaaacaatgggacatttaatctaaaagcaaatgaataa

SEQ ID NO: 12 - DNA, 2124 bp, Dendroctonus ponderosae
atgggtaataccgagagtaatgttactagtggcgtcaaaaaacaggcgggagccgccatgcagccgatatataaactttgtgatttgaaagggggcggtctgctggtggaacttatgaaaagggcagcccagaataagcagtacgcggaaatagatcacgccatcaaaactaaggtggaacattttctgtacaataaaggtgccgggcgttatatcccaatatctcaaatggtgcttttaaggaacaaggaacgcgggaagcataaactgctgccccaacttagaggaatggaaaatcctgaggattttgaagtcgatgatgaaggacccgaaataactgaagaagagtacaataaagatccatcattatatcggcatgtttgttggaagctgagagaaagaggagcggttggagaaacaattttacatctttgtttattgaatgccacttctctacatgcagacatcgccaagaggctattgaggttctatcccaaattgatcaacgatatttacatatcagatgaatactatggtgaaaatgttctacatatcgccatagttaacgaggatccttccatggtaaagtttcttcttgccgcaaatgtgaactttcaggaaagatgtttcggtaatttcatgtgtccagaagatcagaaatcatcgagaactgattctctagatcacgaatgggtgaatgtttatcacgaaacaaattatgatggatatgtgtactggggtgaatatccattgtcatttgctgcatgtttaggtcaagaagaaagttttcgattaattttggcaaagggtgccaatttagatgcacaagacactaatggaaacactgtcctgcatttattagttatttattccaaagtggaagctttcgatatggcatatgaattaggtgctcacctttcaataaggaacattctgaaaatgacacctttaacgctggccgccaagctagcaagaatggatatatttttccatattttaaagctagagagggaaatatactggcagataggaagcattacatgtgccgcctatcctctatctcagattgatacgatagatgttaagactggacaaatcagtaaaatgtcagcgctgaatctggtagtatttggtgataaagatgaacatttagaactgctcgatggagtattagttgatctattaaatgccaagtggaatacgtttgtgaaatctaaattttaccggcaattttttacttttgcgttttatttcaccgtatcgcttgtggataccagcaatgatgattatgatgttgaggaatggtgggataatttacgagaggaatgtcgattaatgaatttagacacgactgagtcactagtgagatttactgctgaacttggaatcacgtttggtgcatttctttatttggcggccgcaatgactgctccttcgagagttatgttcttgttttcctgcattttggtttttggagtaattcctagcctgcgcttggtatgcatggatgaagttgaagatataatcgcagtagtagttatgctaacgacggctccatatttcctatttttctgtagaggctttaaaacagtaggtccgtttgtggtaatgatctatcgcatggttctaggcgacttgctacgtttcgcaactatatacatggtttttgtcatgggattttctcaagcatactacataattttcttgtcttttgataacccattgacaccagaagacgtcgatgactcggctacgaatccaatgtcaactccatccgaatccattatggcaatgtttttaatgtccatgaccaacttcggagattattacacagcatttgctaggaccgagcacgaatatgaggctaaaattcttttcgtaatatttatggccattgtggcaattttgttaattaatatgttaatcgctatgatgggtaacacataccaaaagatagcggaaacgcgtaacgaatggcagcgacagtgggctcgcattgttttggtcgtagaaagaggtgttagcccacctgaacggctcaagcaattgaatgtttattcacaaccaatgagcgatggcaaaagagctctcgttttaaggctcaaccagtcggtaagatattag

SEQ ID NO: 13 - DNA, 2718 bp, Harpegnathos saltator
atgggcaataccgagagcaacgtcacgagcggcgtgaaaaagcagacggacacgtcgtccatcatgctttataagttggtcgatctgaaaggcggtgggttgttcgtagacatgatgaagagagcagcgcaaactaagcagttcgcagagttggatcacgcggtgagaacaaaggtcgagccctacctgtacaacaaaggaaagggcaagtggatacccgtggacaaactggttcttctaagaaacaaagatcgtccgcgacataaaatgctggcacctttgaaagccatggaaaatccggcggattacgacatagataaggacatgggtgatgaagatgttgacgagactaaaatagacaaaagcaaatacagactggtctgctggagcctgagcgagagaggcgctgtcggtgaaactatcctgcacttgtgcatgttaaatgccactgctctccacgcggatctggcgaaacgattgctacgcttctatccgaatctcataaacgacatttacataagcgacgaatactacggagagaacgtgctgcacatcgcgatcgtaaacgaggacccagcgatggtgaagtatcttctagacagcggtgcggatgttcacgagaggtgcttcggtaacttcatgtgtccggaggatcagaaagcgtcaagggttgatagtctggaccacgagtgggtgtgcgttgcaccggagaccaattacagcggatacgtgtactggggagaatacccgttgagcttcgccgcgtgtctgggccaggaggagtgctacaggcttatgctcgccagaggcgcggatcctgacaagcaggacaccaacggcaacacggttttgcacatgttggtgatatatgagaagctgactacgttcgacatggcgtacgaagtgggagcctcgttggccataagaaacgtccaacacctgactccgctgacgttgtcagcaaagctggccaagatcgagatgttctttcacattctgaacatcgagagagagatatactggcagatcggtagcataacttgcgcagcttacccgttgtcgcaaatagacacgatcgatattaacatcgggactatcaacaagaactccgccctgaatttggttgtttttggggaaaaagacgagcatctagaattgatggacggtatgttagtcgaccttctgaacgccaagtggaacactttcgttaagtctcgattctaccgtcaattcttcctcttctgcttctacttcgtgctgtcgctgatcagcttcactcttcgcccgggcccgttgccgcaggagaccgaaaatgcgaacgatacgagaacgaattcatcgaacgcaacggcgatggagattcttaggttgttccaaagctcggacctgtcgaacctcgtcacgaacagcctcgccgcggcttttgcctcgaacctcaaatcgtccttaaacgtgacgcaagaatcgttggagaagatccagctgcaagtgacgtcgaacattacatcggccctgaagaatattttgccttcgctgagcgacaacgagggcatcctgagtgcccctgacgaagccgccattcgtacgctgtggtataccagtagtccgtacaatgagtcagattacttgacagatgcttacaacgagaatgtcacgagcgatgcgaattcgaccgcggggacgatcatcggcagcatcgaggtgtcgaagtccaacgataaggacaattggtgggaagatctgacggaagaatgcaggctgatgcagctaacgacgataagtgcgaagatccggctgactgcggaagtgctgatggaaatcgccgcggtgctctacattttagccgcactgcgggaggcgaggtttttggggctcaacatgttcgtcgagaatctaatgacagcgccgtcgcgcgtcatgtttctcttctcgtgctgcatcttactctcgtttccatttctgagattagcctgcgccgacgaagtcgaagacatgttggcggtcgtggtgatgctgacaacggcaccgtatttcttattcttctgcagaggcttcaagacggtcggtccgttcgtcgtgatgatttacaggatgatcatgggcgacctcctcagattcgtgtccatctatctggtcttcgtcatgggcttctctcaagcgtactacattatatttctgtcgttcgacaacccgaataccccggaaggcgtcgacgattcggtatcgaacccgatgccgtcgccgatggagagcatcatggcgatgttcctgatgagcatgacgaacttcggcgactactacggcgcgttcgagcgaaccgaacacgagtccgaggctaagctgctgtttgtgttgtacatggcgatcgtggcgatcctgctcgtaaacatgctaattgctatgatgggcaacacttaccagaagatcgccgagaccagaaatgaatggcaaagacaatgggcgcgcatagttctggtcgtggagagaggagtcagccccgccgagaggctgaagaagctcatggactactctcagccgatgtccggcggccgtcgagcgttggtcctccggttgaatcaaagtgaggaggacaaggaggagatgaaggaaatactcgagatgaagaggacccacgatagactgctgaagaagaggcaagggagaatgtcaaaggagaaagttctggccgagagcgaaattattattacccgaaattga

SEQ ID NO: 14 - DNA, 2756 bp, Nasonia vitripennis
atgggtaacgccgagagcaacgtcaccagcggcgtgaaaaaacagacggatgcaggtgcgatcgccctgtacaaactcgttgatctcaaaggtggtggtctgctggtggacatgatgaagcgggcctcgcaaacgaaacagtacgctgagatagatcacgcaattaggacaaaagtcgagccgtttctgtacaacggaggcaaaggcaagtggatacccatagcgaaactggtgctcttgaggaataaagaaagggggagacacaaaatgttacccgtgctcaaagccatggagaagcccgaggactacgatatcgataaggacatggctaacgacccggagccggatgaaaacacaatcgacaagagtaaatacaagctcgtctgttggaccctgagcgacagaggagcagtgggcgagacgattctgcatctctgcatgctcaacgccacgcagctccacgcggatctggcgaagaggctgctgcgcttctatccgaacctcatcaacgacatttacatcgatgacgaatactacggagagaacgtcctgcacatcgcgatagtgaacgaagacccgtcgatggtgaaattcctgctggacagcggagcgaacgtgaacgagcgttgctgcggcaacttcatgtgtccggaagatcaaaaggcttctaggaacgacagcgtcgagcatgaatgggtctgcgtatgctcggaaaccaactacgatggttacgtctactggggcgagtatcctttgagcttcgcagcctgtttggatcaggaggaatgctaccggctgatactagccaaaggcgccgatccagatagccaggacacgaacggcaacaccgttctccacatgctcgtcatttacgaaaagctcgaaaccttcgacatggcctacgaggtcggttcttccttgtcgatacgaaacgtcctgcaactgacacctttaacgctagccgccaaactcgcgagggtggagatgttcttccatattctgaacatcgagcgcgagatctactggcagatcggtagcatcacctgcgcggcttatccgctttctcagatcgacactatcgacgtggacaccggaaagatcagcaacaactcggcgttgaatttggtcgttttcggtgataaagaggagcatctcaaactgctggaaggcgtgctgatcgatctactgaacgcaaagtggaatactttcgtcaagtccaggttctaccagcagttctacctcttcttctgttacttcatcctctcgctgataagctgcaccctccgacctggtcccataacgaagaccgacgctccaaccacgacaccacatcccatgaacgacacgagcatcgagtccatcactccgacctcggaacctttagagctgcagaccttgtcgtcgcttctggcgaaaaacttggccgaacaactcgtcatgggtatgaagatgtacggcaacgtctccgaggactcactcgcgaggataagtctccaggtggcttcaaacatcagcggctcgatcaaggacatctggacgaggcagaacctcacgagcaacgacaccgactacgtcgatatcgcaggaggtctgtacgcggacgtcaacgagaccagcgcgagtgatcccttcgatttgaacgcgagcgatatcgtgattcttaagaagggaaagaaggaactcgatgactggtgggatgacctaaccgaagactgccgactcatgcagatgaacagtacctcggcgaaaatccgcctgacggccgagatattcatggaattcggcgctatactttacatatgcgctgcgctccgagaggcgaggttcctcgggctcaacatgttcatcgagaatctcatgacggctccgtcgcgcgtcatgtttctcttctcctgctgcatcctcctgtcctttccgtttctgaggatgtcctgcgccgacgaggtcgaggacatactcgctgtagtggtgatgctcacgaccgcgccctacttcctcttcttctgcagaggcttcaagaccgtcgggcccttcgtcgtcatgatctacaggatgatcatgggtgacctgctcagattcgtctcgatctatctggtcttcgtcatgggcttctctcaagcttactacataatcttcctgtcgttcgacaatccgatcacgcccgagggtgtcgacgacagcaaagctaatccactaccgtcagccatggagagcatcatggcgatgttcctcatgagcatgacgaatttcggcgattactacgacgctttcgagaacaccgagcacgagatgttggccaagtgtctcttcgtcgtgtatatggccattgtgtcggttctactggtgaacatgctcatcgctatgatgggcaatacctaccagaagatcgctgaaacgaggaacgagtggcagagacagtgggctaggatagttctcgtggtggagagaggagtagccccggcggagagattgaagaaactgaacgtttactcgcaaccgatgtccgatgggcgtaaggcattggtactgaggttgaatcaaactgacaaagataaggaggagatgaaggacatcctggaaatgaagaggatacacataaaatcgataaagagacgcaaggacaagctgcagaaggcgaaagaagacgctgaaaagctccagcagcagatggccgataaggacaataaggacaaagccgttattatacaatgagaatttttctatgtatataataaagcgctcttgtaaatatattc

SEQ ID NO: 15 - DNA, 2712 bp, Megachile rotundata
atggggaacacggagagtaacgtaactagcggcgtgaagaaacaaacagactcctcttctatcttactttacaagctggtcgatttaaaaggtggtggtttattagtggacatgatgaaaagagcaacgcaaactaaacagtacgctgaactagatcacgctctaagaacaaaagtggagccgtatttatacaataagggtaaaggtaaatggatcccgatagaaaagttggttctactgcggaataaagatcgtccgaagcataaaatgcttccaccattgagggctatggagaatccggctgattacgacatagacaaggatatgggcgaggaagaagtggacgaaacgaagatagataaaagcaagtacagattggtctgctggagcttgagtcaaagaggagcagtaggagagacgattatgcatttatgcatgttacatgcgactgctattcacaccgatctggctaaacgtttactacgtttctatcctaagctcatcaatgacatctatatcagtgacgaatactatggtgaaaatgcattacacatcgctatagtgaacgaagatccagctatggtaaagttccttctagacagcggcgccgacgtgcacgaaagatgcgtaggaaattttatgtgtccggaggatcagaaagcgtcgagaacagacagcgtggaccacgaatgggtttgcgtggctcccgaaacgaattacagcggatacgtttactggggtgaatatccattaaacttcgccgcgtgtttaggccaagaagagtgctacagattgatactcgctagaggagcagatcccgacaagcaagacaccaatggaaacacggttctgcacatgttggtgatctatgaaaagatggccacgttcgatatggcgtacgaggtaggagcatcgttatcgatcagaaacgcgcaacatttgacaccgctgacgttatcggcgaagctggcaaggatcgaaatgttttttcacattttgaacatcgagagggagatttattggcagattggcagcattacgtgtgcggcttatcccctctcgcaagtggacactatcgatgtgaacactggtagcatcagccacacttccgccctgaatctggtggtctttggagaaaaggatgagcacttggaactaatggatggtaccatggttgacctattaaacgcgaagtggaacacctttgtcaagtccagattttatcgccagttcttcctattttgtttttactttattctttacttgatcagtttcactcttcgacctggtccttcggtcacatcgactgctacaactgctccgactacagaatcgaccacaccgaaattgccagatcctcctccaaattttattccagttacgaatcaaaaaacgtttctcgaagcgagcctctcgtcgtccttggatgaaattgtgacaaacgccctgaatttaaatttcccttcgaacgcgacggctcgctttgacgatctaaaactcgatctcgtaacccacataatgtctaatctgaagaacatattgaatgggaacgagaccaaaaacgagccatttaacagctcccaactcgccaggtttgacaaacatttattccgcgaaaatgacactgattattctactagcatcttgaacgagaccgccgacgttgattccacgacgaagttttcgtttgacaattctgtactgtttgaggctgataataaaagcgattggtggactgatcttaccacagaatgccgattaatgcaactgaccaccgcatccgcgaagatccgattaatcgcagaaatatttatggaaatcgcagctattctttacattcttgcagcgctaagagaggccaggtttctaggtctcaacatgttcatcgaaaatctgatgactgtaccatcgagagtaatgtttctcttctcctgttgcatactgctctcttttccgtttctgagattatcctgtgctgacgaagtggaagatgtgctagcagtggtagtaatgttgactacagcaccatattttttgttcttctgcagaggtttcaaaacggtcggccctttcgtcgtgatgatttatagaatgatcatgggcgacctacttcggttcgtatccatctatttggtctttgtaattggattttctcaagcttattacatcatatttctatcttttgataatccaaacacgccagaaggtgttgatgattcagtgagcaatccaatgccatcaccaatagaaagcatcatggcaatgtttctaatgagtatgacgaactttggagattactatggtgcatttgagaggacccgacatgaaatggaagccaagtttctgtttgttgtatacatggctattgttgctatcttacttgtgaacatgttgattgctatgatggggaatacgtatcaaaaaattgcagaaactaggaatgaatggcagagacaatgggcacgtatagttttggtagtagaaagaggagtaagtcctcaagaaaggcttaaaaaattgatggattattctcaaccaatgtctgatggccgcagagcattggtgctcagattaaatcaatcggaagaagataaggaagaaatgaaggagattttggaaatgaagaggactcatgagagattatataaaaagaggcaacttaaaacaacaaaagaaaagactacaataacagaggagaatgttactttatag

SEQ ID NO: 16 - DNA, 2664 bp, Apis mellifera
atgggaaatacggaaagcaacgtagccagcggagtgaagaaacagacggacgcatcgtccattttgctttacaaattggtcgacttgaaaggtggtggcctattggtggatatgatgaaaagggcaacgcaaactaaacagtacgcggaattggaccatgccctgagaacaaaagtagagccatatttatataacaagggtaaaggtaaatggatcccgatcgagaaattggttttgctgagaaacaaagatcgtccaaagcacaaaatgcttccaccgttgcgagctatggaaaatccggccgattacgacatagacaaagatatgggcgaagacgaggtggacgagacgaaaatagataaaagcaagtacagattagtgtgctggagcttgagcgagagaggagcggtcggtgaaacgattctacatttgtgcatgctacacgcaactgctattcacatcgatttggctaaacgtttgctacgtttttatcccaagcttatcaacgatgtgtacataagcgacgagtattatggcgagagcgcgttacacatcgcgattgtaaacgaggacccgtcaatggtaaaattccttttggatagcggtgcggacgtgcacgagagatgcataggaaactttatgtgtccagaggatcaaaaagcgtcgagggcggacagtcttgatcacgaatgggtttgcgtaactccggaaaccaattacaacgggtacgtttactggggcgagtatcctttaaattttgctgcgtgcctgggacaggaagagtgttacagattgatactcgcaaggggagccgaccccgacaagcaagatacgaacggaaataccgttttacacatgttggtcatttacgaaaaattggccacgttcgacatggcgtacgaggtgggagcatcgttggccatcaggaatgcccaacacttaacgcccttgacattgtcggcgaaattggcgaagatcgagatgtttttccacattttaaacatcgagcgagagatttattggcagatcggaagcataacgtgcgcagcttatcctctctcgcaagtcgacaccatcgatgtcgacacgggaagcattagtcataattccgctctaaatctggtcgtattcggcgaaaaagatgagcatttggaattgatggacggaatcctggtcgatctgttgaacgccaaatggaacacgttcgtcaaatttcgcttttaccgccaatttttcctcttttgcttctacttcgtcctgtcgttgatcagtttcacccttcgacccggcccagcaacaacatcgtccgtatccaatcctcagatcacgtccaccgaattgcccacaattcccccaaaaatggatccacccgtccacaattccgatctccccctcctccttgacaaaattctttccaccgctctcgtctcgaaaaggtatccttggaatttgacgagaacgcgtctcgacaagctgaagctcgatatcgtggagaacttgacatccgctttgagcgatatgctcgggacataccgaaacgagatcaaattgtttaaccgttctgacaaaacgtccatctactcgtctagaaacgacgctaaaccgatcgacgagactgtcctccggataaattcgacgatcctgttcaacggcgatgggatatcgtttaccagcaagtacaattggtggaacaatcttacagaggaatgcagactcatgcatctagatacgttatcgacaaagattagattgactgccgaggtattaatggaaattgcggccactctttatatttttgcagcattgcgcgaagccagatttctaggtcttaatatgtttatagaaaatctaatgaccgcaccgtccagagtgatgttcctcttctcatgctgtatattgttaaccttcccgtttctaagattgatctgcgccgacgaaattgaagatatgttagccgtggtcgtcatgctcaccacggcaccgtattttctattcttctgcagaggtttcaaaacggtcggcccattcgtcgtgatgatttacagaatgatcatgggcgatctgctacgtttcgtctccatttacttggtcttcgtgatgggattttcccaagcatactacattatatttttatctttcgataatccaaacacaccggaaggagtagacgattcgatgagcaatccgatgccatcaccaatagaaagtataatggcgatgtttcttatgagcatgacaaactttggagattattatggtgcttttgaaagaacgcaacacgagatggaagccaaattcttatttgtagtttacatggctatcgttgctatattattggtaaatatgttaattgccatgatggggaatacatatcagaaaattgcagaaacgagaaatgaatggcaaagacaatgggcacgcatagttttagtagttgaaagaggagtgagccctgatgaaagacttaaaaaattaatggattattctcaaccaatgtctgatggtcgaagagcattggtacttcgattgaatcaatcggaagaggacaaagaagaaatgaaggaaattctagagatgaaaagaactcatgataaattatacaaaagaagacagagcaaaacaatgaaaaagattttaacatcagaagataatgttattttataa

SEQ ID NO: 17 - DNA, 2739 bp, Apis florea
  modified_base (1240)..(1240): a, c, t, g, unknown or other
atgggaaatacggagagcaacgtggccagcggtgtgaagaaacagacggacgcgtcgtccattttgctttacaaattagtcgacttgaaaggaggtggtttattggtagatatgatgaaaagggcaacgcaaactaaacaatacgcggaattggatcacgcactgagaacaaaagtagaaccgtatttatataacaagggtaaaggtaaatggatcccgatcgagaaattggttttgttgaggaacaaggatcgtccaaagcacaaaatgcttccaccgttgcgggctatggaaaatccggccgattacgacatagacaaagatacgggcgaagatgaagtgagggacgagacgagaatagataaaagcaagtacagattagtatgctggagcttgagcgagagaggagcagtcggtgaaacaattttacatttgtgtatgctacatgcaactgctattcacatcgatttggctaagcgtttgctacgtttttatcccaagcttatcaacgatgtttacataagcgacgagtattatggcgagagcgcattacacatcgcaatcgtgaacgaggatccgtcaatggtgaaattccttttggatagcggtgcggacgtgcacgaaagatgcataggaaactttatgtgtccagaggatcaaaaagcgtcgagagcggacagtctggatcacgaatgggtttgcgtaactccggaaactaattacaacgggtacgtttactggggcgagtatcctttaaattttgccgcgtgtttgggacaggaagagtgttacagattgatactcgcgaggggggctgaccccgacaaacaagatacgaacgggaacaccgttttacacatgctggtcatttacgaaaaattggcgacattcgatatggcgtacgaagtgggcgcatcgttagcgatcaggaatgctcaacacttaacgcccttgacgttgtcggccaaattggcaaagatcgaaatgttttttcacattttgaacatcgagcgagagatttattggcagatcggaagtataacgtgcgcagcttatcctctctcgcaagtcgacaccatcgatgtcgacacgggaagcattagccacaattccgctctaaatctggtcgtgttcggcgaaaaagacgagcatttggaattgatggacgggattctggttgatctgttgaacgccaagtggaacacattcgtcaaatttcggttttatcgtcaatttttcnctttttgtttttactttgtcctgtcgttgatcagtttcacccttcgacctggcccagcgacgacatcatccgttcccaaccccgtcgctcaaacgccccttacgtccaccgaattgtccacaatttccccaaaagtggatcctcccgtctcgaacgttactgtcaatcgaagctcgaatgctttccaacacgattccaatctctccctccttcttgataaaattctttccactgcaagcgtaaaatatccttggaacgtgacaagaactcgtctcgataagctgaagctcgatatcatcgagaatttgacaaccgctttgaacaatctactgtcgacacaccgagacgagatcgaattttttaaccactcttacaaaacaaccgaatatttccattctacgagaaacgataccacgccgatcgataatttgaaaattacgatcaatgaaactgtcctttcggtaaattcgacgattctgttcaacgatgggatatcgtttgccactggcaaatacaactggtggaacaatcttacagaagaatgtagactaatgcatgtagatacgttatcgacaaagattagattgactgctgaagtattaatggaaattgcggccactctttacatttttgcagcattgcgagaagccagattccttggtcttaatatgttcattgaaaatctaatgactgcaccgtccagagtgatgtttctcttttcctgctgtatattgttaaccttcccatttttaagattgatttgcgccgaccaagttgaagatatgctagctgttgtcgttatgttaaccacggcaccgtatttcttatttttctgtagaggtttcaaaacggtcggcccattcgtcgtgatgatttacagaatgatcatgggcgatctcctccgtttcgtctccatttacttggtcttcgtgatgggattttcccaagcatactatattatatttttatctttcgataatccaaatacaccggaaggagtagatgattcgatgagcaatccaatgccgtcaccaatagaaagtataatggcaatgtttcttatgagcatgacaaactttggagattattatggtgcttttgaaagaacgcaacacgagatagaagccaagtttttatttgtagtatacatggcgatcgttgctatattattggtaaatatgttaattgccatgatgggaaatacgtatcagaaaattgcagaaacaagaaatgaatggcaaagacaatgggcacgtatagttttagtagttgaaagaggagtgagccctgaggaaagacttaagaaattaatggattattctcaaccaatgtccgatggtcgaagagcattagtacttcgattgaatcaatcggaagaggacaaagaagaaatgaaagaaattctagagatgaaaagaactcatgataaattatacaaaaaaagacagagcaaaataatgaaaaagattttaacatcagaggataatgttattttataa

SEQ ID NO: 18 - DNA, 2472 bp, Pediculus humanus
  source: /note="Pediculus humanus corporis"
atgggaaatacagagagtaacgttacgagtggtgtaaaaaaacaagcgggaacatccgaacaaccattgtacaaattagtcggtttaaaaggtggaggtcttttggtcgacatgatgaaaagagcgacacaaacgaaacaatatgctgaattagatcacgcgatcaaaacaaaaattgaaccttttttatataacaaaggaaaaggaagattgatacccatatcacagttggtacttttaagaaactgcgaaagatctagaacaaaattgcttccgcttcttaaaaacatggaagatccagaatctgaatttgacatggatcgtgatggaaatcctggagattttcaaccggctccagatggcgtacaagaagattttcacgattacaataaaaaatatagagacgtttgttgggatttgaaaaaaaggggagccgtgggagaaacatgccttcacctgtgcatgcttaatgccacgtcaatccacgcggatttagctaaaagattattaaaattttatccgaaacttataaatgacatttacatgtcggacgaatattacggtgaaagcgttcttcacgtggcaatagtaaatgaagatcctgccatggttaaatatttactcgatagcggttctaattttcacgaacgttgttttggaaatttcatgtgtccagaagatcaaaaagcaacaagaacggattctctcgatcatgaatatgttaatttatcaacggaaactaattacgaaggatacgtttattggggagaatatccgttaagttttgcagcttgtttgggacaagaagaaagttatcgtttgatgcttgccaagggtgccaatcccgataatcaagatacaaatggcaacactgttttacacatgctcgtcatacataataaattgcccatgtttgacgtggcttatgaagttggcgccaatttatcgttaaaaaatgcaaaatgtctaacgccacttacacttgcggcaaaattagcaagagtcgaacttttttttcatattttaaacatagaaagagaaatttattggcaaatagggagcataacgtgtgcggcatatccgttatcacaaatcgatacgattgatatcgaaaccggaaacataagtaaaaattcagcgttaaatttagtcgttttcggagaaaaagacgaacatttagaactcatggatggagtattggtagatttattagtcgcaaaatggaacacctacgttaaattcagattctacaggcaatttatatctttttttttctattttcttatctctgttatctgttttacacttcgacccggtcctccgacaggaacaacaacaacaacaaacggtatcgtcgttttaaataataataacaacaacataacgtccgttgttgataattcaaataacgttaccaccaccaccgccacaactactgccacgtcatattcttttcctggtcacgtgatagtgacacttttatcgtatgataaatacgaagataaaatacgtataatatcagaattagcgatggaaatcggatctgttttgtatttgttaggagcattgagagaagctaaatttttagggattcacatgtttattgaaaatttgatgacagctccgtcgagagttttatttttaggttcttgttgcataatgcaattcgtaccttggctcaggatcacgtgtaaagaagaaacggaagatatcgttgccgttatcattatgttaacgacggctccatattttttatttttttgcagaaaaatgaacgaccccgtttttctttttcttttttttttaataaaaaaaattttttttctaattttttttttttttttttttacaaagccaacttattatataatattcctttcgtttgataatccaaaaactcccgatggagtcgacgattctggaacaaatccaatgcaaagcccagttgaatccataatggcaatgtttttaatgtctctgacaaattttggagaatattacggtgcattcgaaaagactgaacacgaatttgttgcaaagttaatgtttgtcgtttacatggctatcgttgctatattactcgttaacatgttgatcgccatgatgggtaatacgtatcaaaaaatagcagaaacgagaaacgaatggcaaagacaatgggcaagaattgttttggttgttgaaagaggtgtgagtcctcaagaaaggttaaaaaaattaatgctttattctcagcctatgtctgacggaagaagagcattagttttacgattgcatcaaacgccagaagacaaagaagaaatgaaagaaatattagatatgaaaagaatacacaatagaacggttcaaaggcgaaaagctaaagaaaataaaaatgtcacgtttgctggtacccctaaaaatggcattaaaaatcgtttgctcggtcccgttcccccattaaaaagcataccgtcaaaacctaaaatttaa

SEQ ID NO: 19 - DNA, 1068 bp, Danaus plexippus
atgctggagtcaggaggtggtttacttgtggacatgatgaagagggcggttcagaataagcagtacgctgagatagaccacgctatcaagactaaggtggagccctttctctacaataagggcaagggcaggcatatccctatatcgcatcttgtgctgttgaggaataaggaacgagggaggcataaattgctgccaccgttacgtggcatggagaatcctgacgaagagtttgatgtagagaaggattggccagttgtgacccaggaagaatacgaggcgaatccctcggcttacagggagctttgctgggacctgaaggaacgcggtgccgtcggtgagacaatccttcacctttgtcttctaaacgctacctcacttttagctgatttagccaagagattgcttcgtttttacccaaaacttataaacgacatttacatgagcgacgagtattacggtgagagcgtacttcatatgactattgtaaacgaggacccgactatggtgaaatttcttttggattccggagctgattatcatgaacgttgcttcgggaacttcatgtgtcctgaggatcagaaggcctcccgaacagattccttcgaccacgagtgggtcaacgtccagccggacaccaactatgacgggtacgtatattggggggaataccctttaagtttcgcggcctgtctcggtcaggaggagtgctacaggctcatactggcaagaggagcgaaccccgacaaacaggacaccaatggcaacaccgtactgcatatgctgatcatttatgataaaataagcacattcgatatggcgtatgaagttggtgcatccctaaacatcaggaacgttcagaacctaacaccgctcaccctggccgctaaactggcgagagttgagctgttcttccatatcctgaacattgaaagggagatctattggcaaatcggagccaccacctgtgcagcgtatcctctgggacaagttgacactattgacaccgagaccggaaggattagtaaagattcggcgctgaatttagttgtatttggggttagttag

SEQ ID NO: 20 - DNA, 2583 bp, Solenopsis invicta
ggcggattgttagtggatatgatgaagagagcctctcagaccaagcagtacgcggagttggatcacgcgatgagaacgaaggtcgagccgtttttgtacaacaaaggaaagggcaaatggatacccatagaaaaattggtcctcctacgaaataaggatcgtccgcgacataaaatgctaccacctttgaaagccatggaaaatccagcggattacgatatcgataaggatatgggcgatgaggaagtcgacgaagctaagatagataaaagcaaatataggctggtgtgctggaatctgagcgacagaggtgccgtcggcgaaaccattttgcatttgtgcatgttgaacgcgacagccatccacgccgatttggcgaaacgactgttgcgtttctatcctctgcttatatacgatatttatttgtgcgacgagtattacggggagaatgtcttgcacatcgctatcgttaacgaggacccgtcgttggtcaagtttcttctggatagtggagcggacgatccgcgcattatccacgaaaggtgcttcggcaccttcatgtgtccggaggaccagaaggcgtcgaggtttgacagtatggaccacgagtgggtgtgcgtcacaccggagaccgattacaatggctatgtgtactggggagaatatccgttgagtttcgccgcatgcctcggtcaggaagagtgctacaggcttatactagccagaggcgcggatcctgataagcaggacacgaatggcaacaccgttttgcacatgctggctacgttcgacatggcttatgaggtaggagcttctctcgacataagaaacgttcaacacctaactccgttgaccttagcagcaaagttggccaggatcgagatgttctttcacatcctgaacatcgaaagagagatatactggcaaatcggtagtataacttgcgcagcctaccctttatcgcaaatagatacgatcgatgttaacacggggacaattaacaaaacttctgccctgaatctggttgtttttggcgacaaagatgaacatttagagttgatggacggaatgctagtcgatctgctaaacgccaagtggaacactttcgttaaatctcgattttaccgtcaattcttcctcttctgcttccacttcgtgctgtcgctgattagcttcactcttcgccctggcccgtcgaccatggaaacagatgaaaacgcgaacgatacgtcgacgaagacaaattcttcaaatataacagagcccataattctcaagcccctccaaagctcggatctgtcggaactggttacgaatagcttcgtggcggcttttgcgtcgaatctcaagtcatccttaaacatgacgcaggaatcattggagaaaatccagctgcaagtaacatcgaatatcacatcggccttgaagagcattttgctcttgacgttgaacgaaaacgagggcattctgagtcctcctgacgaggccaccatccatacgccgtggtataccgacagctctccaaatacgtcggactatttcacagatctctacaataaaactgtcgtagccgaaaattcgactgtcaaggcagttgtcgatgacgtcgcgcaaaccgattactggtgggacgatttcgccgaggagtgtagactgatgcagctaacagaaacgagtgcgaagattcgtctaactgcggaaacttttatgtacatcgcagcggtgctttatatcttggctgcattgagggaggcgagatttttaggtctcaacatgttcatcgaaaatctcgcgacggcgccatcgcgcgtgatgtttctgttctcgtgctgtatcctgctgtcgttcccatttttgcgatttgtctgcgcggacgagatcgaagacatactggcggtcgtggtgatgctgacgaccgcgccgtactttctgttcttctgccggggcttcaagacggtcgggccgttcgtcgtgatgatttacaggatgatcatgggcgacctcctcagattcgtctgcatctaccttgtcttcgttatgggattctcccaagcgtactacatcatattcctgtcgttcgacaatccgaacactccggagggcaccgacgactcgataacgaatccgatgccgtcgccgatggagagcgtcatggcgatgttcctgatgagcatgacgaacttcggagattactttggcgcgtttgaaagaaccgagcacgagttcgaggccaagctgctgttcgtgttgtacatggtgatcgtggcgatcctgctcgtaaacatgttgatcgccatgatgggcaacacttaccagaagatcgccgaaaccaggaatgaatggcagcggcaatgggcgcggatagttttggtcgtggagagaggtgtcagtcccgctgaaaggctgaaaaaattgacagactattctcagcccatgtccgacggccgtcctgcgttggttcttcgattacatcaaactgaggaggacaaggaagagatgaaggagatactcgagatgaagagaacccacgaaaaattgctgaagaaaagacaatgcaggatgtcaaaggagaagattctgtct

SEQ ID NO: 21 - DNA, 2586 bp, Acromyrmex echinatior
atgggtaataccgagagcaatgttgcgagcagcgtgaagaaacaaacggatacgtcgtccatcctgctctataaattagtcgacttgaagggtggcggattgttggtggacatgatgaaaagagccacgcagactaagcagtttgcagagttggatcacgcgatgagaaccaaagtagaaccgtttctgtacaacaagggaaaaggcaagtggataccagtggacaaattagttcttctacgaaataaagatcgtccgcggcataaaatgctaccgcctttaaaagctatggaaaatccagctgattacgatatcgataaagacatgggcgacgaggaagttgatgaggccaagatcgataaaagcaaatatagactggtatgttggaatttaagcgacagaggtgctgttggcgaaactatcttgcatttgtgcatgttgcacgcgaccgccattcatgctgatttggcaaaacgactgttgcgtttctatccgaagcttataaacgatatttatctaagcgatgagtactatggagagaatgtcttgcacatcgctattgtaaacgaggatccatcgatggttaagttccttctcgacagcggagcagacgatccgtgcattatccacgagaggtgcttcggcaacttcatgtgcccagaagatcagaaggcgtcgaggtttgacaatatggaccacgagtgggtgtgtgtttcaccggaaaccaattacaacggttatgtgtactggggagaatatccgttaagcttcgccgcatgtctcggtcaggaagagtgctacaggcttatattagccagaggtgcagatcctgataagcaggacacgaatggcaataccgttatgcatatgctagccacgttcgacatggcttatgaagtaggagcttctctcggcataagaaacgttcaacatctgactccgttgactttggctgcaaagttggccaggattgagatattctttcacatcatgaatatcgaaagagagatatactggcaaatcggtagcataacttgcgcagcctaccctttatcgcaaatagatacgatcgacgttaatacgggcacaatcaacaataattccgccctgaatctggttgtttttggtgataaagatgaacatttagagttaatggacggtgtgttagtcgatcttttaaatgccaagtggaacaccttcgttaaatcccgattctacaatcaattctttcttttctgcttctacttcgtactatcgctgattagcttcacccttcgacctggcccatcaaccatagaaacagacgaaaatgcaaatgatacgtcgacgaggacaaattcctccaacataacggagcctataattcacaagactctccaaagctcggatctgtcagaattggttacgaatagtctcgtagcggcttttacctcgaattttaaatcatccttaaatatgacgcaggaatcgctagaaaagatccagctacaagtaacgtcaaacatcacgtcagccctgaagagcattttgctcttgacgttgaacgaaaatgagggcattctgagtcctcctgacgaggccaccattcatacgctgtggtataccgatagccctccaaacgcgtcggattattttatgaatacttacaacaaaaccgacgcgaattcaactgtcaagacaattatcgacggcgtcgcgcgaccaaaatttaaaagcaattattggtgggacgatttctcggaggagtgcagactcatgcagctatcagaaatgagtgcaaaaattcgtctaactgcggaaatttttatgttcatcgcagcggtgctctacattttggctgcgttgcgggaggcgaaattcttaggtcttcatatgttcatcgaaaatctcatgacggtgccgtcacgcgtgatgttcctgatctcgtgctgcatcctgatgtggttcccggttctgcgatttacttgctccgacgaggtcgaagatatgctagcagtcgtagtgatgctgacgacggcgccatactttttattcttctgccggggcttcaagacggtcggaccgttcgtcgtgatgatttacaggatgatcatgggtgatctcatcagattcgtctctatctacctcgtttttgtcatgggattctctcaagcatattacatcatattcctgtcattcgacaacccgaatactccagagggcatcgacgactctatcacgaatccgatgccatcgccgatggaaagtgttatggcgatgttcctgatgagcatgacgaatttcggtgattactttggcgcgtttgacagaaccgagcatgaattcgaggccaagctgctgtttgtattgtacatggcgattgtggcaatcttgctcgtgaacatgttgatcgctatgatgggcaacacttaccagaagatcgctgaaaccaggaacgaatggcaacggcaagaggaagacaaggaagagatgaaggagatactcgagatgaagagaacccatgatagattgctgaagaaaagacaaaatagaatgtcaaaggaaaagattatatttgaaacagaacctattattaccaagaattga

SEQ ID NO: 22 - DNA, 2715 bp, Camponotus floridanus
atgggtaatacagagagtaatgttacgagcggtgtaaagaaacaaacggacacatcgtccatcgtgctttataaattagtcgatttaaaaggtggtggtttgttagttgatatgatgaaaagagccactcagacaaagcagtttgcggaattagaccatgcgatgagaacgaaagtcgagccctttttatataacaagggggaaggcaaatggatacctatagacaaattggtcctcttacgaaataaagatcgtccgcgacacaaaatgctagcaccgttaaaagctatggaaaatccagcggattacgatatagacaaagatatgggcgatgaggaagttgatgaaactaagatagataaaagcaaatatagattagtgtgctggaatttgagtgagagaggtgctgtcggcgaaactattttgcatttatgtatgttaaacgctactgctctccacgctgatttggcaaaaagactattacgtttctatccgaagcttataaacgatatttatctatgcgacgaatattacggtgaaaatgtattacatattgctattgtgaacgaggatccatcgatggtcaagtatcttctcgacagcggcgcggacgacccgcgcattatccacgagagatgcttcggtaattttatgtgtccggaagatcagaaagcatcgaggtttgatagtcaagatcacgaatgggtgtgcgtcacaccagaaaccaattataacggatacgtgtattggggagagtatcccttgagctttgccgcatgccttggtcaggaagaatgctacagacttatacttgccagaggtgcggatccggataaacaggatacgaatgggaacaccgttttacatatgctggctacgttcgatatggcctatgaagtgggggcttctctagacataagaaacgttcaacatctgactccattgactttggcagcaaagctagctaggatagagatgttctttcacattctgaatatcgagagagagatatactggcaaataggtagcataacttgcgcagcctatcctttgtcgcaaatagatacaatagacgttaatgcaggaacaatcaacaataattctgctctaaatttggttgtttttggcgagaaagatgaacatttagagttaatggacggcgtcctaatcgatcttttaaatgccaagtggaacacttttgttaaattccgattctatcgtcaattcattctcttctacttctactttgtgctatcgctgattagtttcactcttcgtcctggcccgcaaacagatgaaaatgcgaatgatacattgacaaactcattcaacacgacgagggaatccatgattctcaagtctcttcacagttcggatctatcagaactggttacaaatagtttcacagcagcttttacttcgaacttcaaatcatccttaaacgtaacgcaagagtcattggagaagatccagctgcaagtgacgtcgaatgttacatctgctctgagaagcattttgcttttaacgttgagcaacaatgaggatcttttgagttcccctgatgaggccgccattcatacactgtggtataccgataatcctcaaaacgcgtcggattatttcataaatatgtataataaaactgttacaattgatactaactcaaccgccaaaactaccatcgacgatgtcacactattaggaaaatttaacaatcacgaaaaatggtgggatgatcttacagaagaatgcagactgatgcaattgacaacaatgagcgcgaagatccgtcttactgcggaaatcgtgatgtattttgcggcagtgctctacatcttggctgcgttgcgagaagcgagatttttaggtctcaacatgttcattgaaaatctcatgacggcgccgtcgcgcgtcatgtttctgttctcgtgttgcatcttaatgtcgtttccggttctgagactttcctgctccgatgaggtcgaagacgtgctggcagttgtagtgatgctaacaacggcgccatattttttattcttctgccgaggtttcaagacagtcggcccgtttgtcgtgatgatttacagaatgattacgggcgatctcctcagattcgtctctatctatctcgtcttcgtgatgggattctctcaagcgtattatatcatatttttgtcgtttgacaatccgaatactccggaaggcgttgacgattcgataacaaatcctatgccatcgccgatggagagcgttatggcaatgtttctgatgagcatgacaaatttcggcgattattatgccacgtttgacagaaccgagcatgaattcgaagccaagctgctgttcgtgttatatatggcgatcgtggcaatcctgctcgtaaacatgttgattgctatgatgggcaacacttaccagaagatcgctgaaaccagaaatgagtggcagagacaatgggcgcgcatagtcttggttgtggagagaggcgtaagtcctgctgaaagattaaaaaaattgatggactattctcagcccatgtctgacggtcgtaaagcgttggttctccgattaaatcaaactgaagaagacaaggaagaaatgaaagagatacttgaaatgaaaaggacgcacgataaattaataaagaaaagacaagacaaaatattaaaggagaaagctttagctgaaacagaagctgttattactagaaaataa

SEQ ID NO: 23 - DNA, 2550 bp, Myzus persicae
  modified_base (210)..(638): a, c, t, g, unknown or other
  modified_base (899)..(984): a, c, t, g, unknown or other
  modified_base (1863)..(1883): a, c, t, g, unknown or other
cgcgatcaaaacacaagtggaacccatgctgtacaacaagggtgaaggcagaatgataccgattgccaaactcgtgttactgagaaatcgcgaccgttcccgggcaagatggcttccaccgttaaagaacatggaagacgccaatgaatacgatatcgaaaaagacattcccaccatcgaagaactggaaaagctgggggaagtgcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaagaggagccgatccaaataaccaggataccaacggcaatacagttctgcacatgctcgtaatttacgaaaaaatctcgacgttcgacatggcctacgaaatcggggcggagctcaacattaggaacgtgcaaaatttgacaccactcacgctggccgcgaaactggctcggatccaaatgttctttcacatactcaaaatcgaacgggaaatttattggcaaatcggcagtatcacttgtgccgcgtaccccctgnnnnnnnnnnnnnnnnnnnnnnnnnnnnnnnnnnnnnnnnnnnnnnnnnnnnnnnnnnnnnnnnnnnnnnnnnnnnnnnnnnnnnnacacttggagatgatggacggtgtgttggtggatctgctaaatgctaaatggaacgctttcgtgaaattccggttctataggcagttcatcttgttcgcgttttacttttccatatccatggtgtgcttcgttttgcgtcccgggccgccacccactggtcttaagccgccattaatcaactacacttcgacgtcgaccacggtggccaccacgccgtttgacttcatggacaacgagtcgatgttgcccgacaacgtcatgtacgacgaaatgatgatcggcggtggcggtccgaccgaattcgaaacgccggtggtaaccacggagatggcgacggtcaatgacaacgccacaaccaacaacggtaccggtatcatccgtacgccactgatctacgaggacggtgctggaggtggtggtggaagtggtaccgtaagcttgcacggtaagagttccggttcggacaggggcaaacacaggagcacgtggaatcccgccaaccatacgttcaagaccaactacacgtacaactacaacaaatcgagaaaattttggtggaacaagagacaaaaggtgtgcagattaatggcagtgcattcgactgatgatctaatcagaatggggtcggaagtgggaatgtttgtgggagccttcctctatctactggccgcagtcagagaagctggatttttgggctcccagatgttcattgaaaacctggccatagcaccggcaagagtgatgtttctgttctcgtgcctgctcatgatgaccataccaccactgagactgacgtgctatgacaaagccgaagacataatagccgtaatcatcatgttgaccacttgtccgtactttttgttcttctgcaggggttnnnnnnnnnnnnnnnnnnnnntggtgatgatctacaggttggtgatgggagacttgctgagattcgtttccatttacatggtgttcgtgatggggttctcgcaagcttattacgtgattttcctatcttacgacaacccgctgacaccagagggcattgacgattccgtgctgaacccgatgcccacgccgaccgagtccatcatggcgatgttccttatgtccgtcaatacgttcacagattactacacggcgttcgacaagactagtcacacgttggtcgcaaagttttgctttatagttttcatggtgatcgtggccatattgccggtgaacatgttaatcgccatgatgggggacacttatcaaaagatcgccgagaccagaaacgaatggcagagacaatgggctcggatcgtactggtggtagagagaggtgtcagcccgtcacagaggctcaaaaagctcatgtactactcgcaaccgatgtcagatggtcggagggcgttggtgttgcgactcaatcagacggatgaagacaaggagcaaatgaaagagatattggaaatgaaacgcattcacaatcgctatgttgaaagaatgcgcgcaagagacctgagcagcaaactatcgtcttcgtgcggaaaaaatgcaaacgatgggacaattaatttaaaagcaaataaata

SEQ ID NO: 24 - DNA, 2502 bp, Bemisia tabaci
  modified_base (877)..(1717): a, c, t, g, unknown or other
gatcctgagaaaattgatccgaagaaatgccgagaggtatgctgggatttgatggaacgtggagcggtgggtgaaactattctccatctgtgcctcctcaacgccacatccatccatgcagacttggccaagcgactcctccgcttttatccgaaacttatcaacgatatatacatgtgcgacgaatattacggtgaaagtgtgctacatattgccatagtgaacgaagatccagcgatggtgaagttccttttagacagtggcgctgactaccacgagcgttgtaccgggaacttcatgtgtcctgaggatcagaaggctacaaggcaggacacagttgagcatgaatgggtgaatctgtcgccactcaccaactacgagggatacgtgtactggggtgagtacccacttagttttgcggcttgtctgggccaagaagagtgcttccgactcatgctcgcgcgaggagcaaatcccgataatcaagacacaaatggaaataccgttcttcatatgctcgtcatctatgagaaactcgaaacatttgacatggcatacgaagttggcgccaacatttctgttcggaatgtccagaatttgactcctctcactttggcagcaaaactcgcgagaattgagatgttcttccacattttaaacatcgaacgcgaaatctattggcaaattggcagtattgcatgtgcagcttatcctctagggcaaatcgacacaattgacatcgaaacaggacacatcagcaaaaattcggctcttaatcttgtggtctttggggacaaagacgaacatctggagttgatggatggcgttttggtggaccttttgaacgccaagtggaacgcttttgtcaaattgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgataatgttgcttacgtcaccatactttctcttcttttgccggggattcaagacggtcggaccattcgtcgttatgatctacaggatggtcatgggggatctactccgattcgtttccatctacatggtcttcgtcatgggattctctcaagcctactacatcatatttctatccttcgacaaccctagtacaccagacggagtggacgacacggtgagcaatccaatgccaaacccagttgaggctggaatggccatgttcctcatgtcactcaacactttcggtgactattttagcgcctttgaaaaaaccgaacacgagctagaggctaaggtatgctttgtaatattcatgggtatcgttgccattctactggttaacatgttgattgctatgatgggtaacacttaccaaaaaatcgcagaaacccggaatgagtggcagagacagtgggccagaattgttttggttgttgaaagaggagtcccaccgaaagagcggctaactaaactcatgtggtactcacaacctatgtccgatggcagacgtgcgttggtcttgcgcctcaatcagacggagcaagacaaagaggagatgaaagagattttagagatgaagcgagtgcacaaccgaatcgtggagaagcggcaaaagcgactggcaaagctgtccaacaatgcaagcccctctaacaagcctctagttgacctgccaaacctttcgaaccatgattcccctacaaagcctctcctcgaccttgccagtaacctcagcaaattttga

SEQ ID NO: 25 - DNA, 2428 bp, Euschistus heros
ctcaggttctaccccaagctcatcaatgacgtctacatgtccgatgaatactatggtgaaagtgtcctgcatattgccatagtcaacgaagatcctgcgatggtgaaattcctactagacagcggtgtcaatgtcaatgaacgctgttttggcaactttatgtgtcctgaggaccagaaggcatcgaggactgattcactcgatcatgaatgggtcaacttgcaatcatttactacttatgaggggtatgtatattggggtgagtacccactatcctttgcggcctgccttggacaggaagaaygctacagattgatgcttgcacgaggagctaatcctgacaatcaggataccaacggaaataccgttcttcatatgctagtcatatactgtaaaatacaaactttcgacatggcctatgaagttggtggagacctatcaataagaaatgtccaatatctaacaccattgacattggcagctaaattagctaggattgaactattcttccacatattaaatattgaaagagaaatatactggcagattggcagcataacttgtgcagcttacccactttcacaaatcgatactattgatattgtgactggaaacatcagcaaaaattctgctttaaatcttgtcgtttttggcgaaaaggatgaacatttggaacttatggatggtgtcctgatcgaccttttaaacgcaaaatggaatgcctttgtaaaatttaggttttatagacagtttttcttatttctcttttacttcttgatttcgcttatttgtttcactctacgacctggacctccaccagttaaaccaatatcaagtttcaacagtaccaaacccagcggaaataacattactgctgaattgtcgccagaaagcaatgcaactactgttccaaaatggatttacaaaacagaaattaaaaagtatgatcccgaagacaacagtagtcaaaacagcagacttaatgtaatattacgtgaagtcattttgacatctttgaaagttgaagatattgataaagtagtttctttttcaaatgcagagccgcaagacaattccagggaagatgcagatggattggtttgcaatggcgattctgttcattcctgtttaggaaatggatctgatgttgttgctgtatttggaaaaggcaagagcccaaaagtaccaaaacctggagcctccgccgatgattttgattatgacgacacttggtgggaagaatttggacaatgcagattacttcaggtcacttcctacattgaaatgacccgccttatatcagaagtcttgttggacatcggagctttgctatacatattagcagcattgagagaagcgagatttctaggatggagcatgtttgtggagaatttgatgactgctccttcaagagttatgtttttgttttcatgctgtttgatgctaacgatgccatttttaagatttacctgcaatgaagaaatagaagacatgatggcagttattataatgctcaccactgctccttattttctgtttttctgcagaggtttcaagaccgttggtccatttgttgtgatgatatataggatgataatgggagacttgttgagatttgctacaatatatcttgtctttgtgatggggtttgctcaagcatattatatcattttcctgtcatttgataacccactgacacccgaaggagtggatgattctgtaagtaatcctattccgaacccaatggaagcagtcatggcaatgttttttatgtcaatgacaagttttggcgattactatccagctttagaaaggacagctcatgaattctgtgctaagctttgttttgtgatatacatggcaatagtagcaattctactggttaatatgttaattgctatgatgggaaatacttatcaaaaaatagctgaaacaagaaatgaatggcagagacagtgggccagaatagtattagtggttgaaagaggagtaagtccatcagagaggttaactaaactaatgtggtactcacagcctatgtcagatggaagaagagcgctggtactgaggctaaaccaatcggaggaagataaagaggaaatgaaagaaattctagagatgaaaagaattcacaacagaatggtacaaaaaaggaaagaaagggaaaagtcgatgaacaaaagcccaaatttgatcaatttaaacagtccggctgaaaatgttaaaaatacaaatcctttcagttaattcagttaacagaacaaagtgaattaaacacaacagaataatcttcttatgaaactatgatatcagcccctgaagtctttgtatcaaatcaagcaccctgtgagcagatgggcaataaacaaaaaatatgttttctatggactagccccaaaatagatctattgatttcaatgaaacttgc

SEQ ID NO: 26 - DNA, 2205 bp, Nilaparvata lugens
ctgcatatggccattgtgaatgaggacccaggcatggtgaagttcctgctgaactcgggagccgacttccacgaacgctgcttcggcaacttcatgtgtcccgaggaccagaaggcatcccgctccgattccttcgatcacgaatgggtcaatctctggcctgtcaccaactacgagggttatgtgtactggggcgaatacccgctatcttttgctgcgtgtttgggtcaggaggaatgctatcggctcatgctagccaggggggccaaccccgacaaccaggacactaatggcaacactgttcttcacatgcttgtcatatacgagaaaatgggaacgtttgacacagcttacgagctgggtgccaacgtatcggtgaggaacattcagaacttgacacctctgacactggcagccaagctggccagaattgaaatgttcttccacataatgaacatcgaacgagaaatttactggcaaattggtagtattacttgtgcggcctatcccttgatgctratcgatacaatagatattgaaacagggratattagcaaagattcggctctcaatcttgtcgtatttggggacaaagatgagcatttggatttgatggaaggcgtgctggtagatttgctccatgccaaatggaatgcatttgtcaagttcaggttttaccgccagttcataatgttcttccagtactttctgatatcgtgcgtgtgcttcatactgcggcctggtccccccgaagcgcacgacggtatgaacatcaccgccaatgctacactcaacctgagcttcggggtgctygaagtccgacctgargcgttgcaagcgytgctctaymggctcgagaagctgtcactgccccagtcgggtgatctggaaaggttcattctggaatctctrgctgatgagaagtcaatttcagaagctgcattagagaacgatgagaatcgggraccaggctggaacaatagtgtrttttcaacgtatgaaacgctggctcgtgatacgggctaccaaactgatgagagtccrcatgacggattgtcgagtagtatggattaygccgaggtggccgagcgattgaccaaactgatgattgatgtcaayctgactgagaggagtggagctgtcaatgagattatactgaaagctttgcctagtcttgaggagaaagaggatggtttggaggagtggtggagcggaatagccggtgactgtatcctgttgcaggtgaatgacctctacgacttggcacgcctgtgcgccgaggtggcgcttgaaattggcgcctttctctacctgctggcagcactgcgcgaggcccgcttcctcggactcaaaatgatgatcgagaatctgatgacggcgccgtcgcgtgtgatgttcctgttctcatgctgcctgatgatgacgatgcccttcttccgcttcacctgccaggacgagaccgaggacatcctggccgttgtcatcatgctcacaacggggccttacttcctcttcttttgcagagggttcaaaacagtgggacctttcgtagtgatgatttacagaatggtaatgggtgatcttctgagattcgtgtctatttacatggtgtttgtgatgggattttcacaagcgtattacataattttcttgacgtacgacaacccgactacaccagaaggtacggacgacactacgtcgaatccactgcccagtccaattgaagccattatggccatgttcttcatgtcactcaccaactttggagattactactctgcgttcgagaacactgaacatgaaatcgaagctaaggctttctttgtgatttacatggtgattgtggcgattcttctaatcaacatgttgatcgctatgatgggtaacacttaccagaagattgctgaaacaaagaacgaatggcaaagacaatgggccagaatagttctggttgtggagagaggtgttagtcctaaggaacgcttgaaaaagctcatgtcctattcacagcctatgtccgatggagggagggctctggttctcaggctgaacatgacggaagaagacaaggaagaaatgaaagaaatcctggaaatgaaacgtgtacgtgataaaattgtcatgaagcgcaaaaaaggcttgaaattgttggggactacaactcctagtccaaagaggatgaaaggccgagaaactcctatttaa

SEQ ID NO: 27 - DNA, 487 bp, Schistocerca americana
ctgcatatggccattgtgaatgaggacccggccatggtgaagttcctgctggacagtggtgccaacgtgcacgagcgctgcttcggcacgttcatgagcccggaggatcagaaggcccagcgctcagactccctggaccacgagtgggtcaacgtcaactcggacacaaactatgaaggctacgtgtactggggggaatacccgctgagcttcgctgcctgcctgggacaggaggagtgctatcggctggtgctcgccaagggtgccaacccagatagccaagacaccaacggaaacacgacactgcacatgctcgtcatccacaggaagatgacccagttcgacatggcttatgaagttggctcttcactcgacattaagaataacctcaacctcacacctctcacgttagccgctaagctggcacgaatagagatgtttttccatatcttaaacatagaaagagagatctactggcaaataggtt

SEQ ID NO: 28 - DNA, 3372 bp, Drosophila melanogaster
atgaagttcctcctgaagaaatgcctgcgcaagaaggcgcccgagatgaaacccggggccatcctggatgccgtcatctcgcaatcatcggccaccgcgtgcaagtgcctgctgtacaaactggcggattacaaaagaggtggtgatctcatcgatgccatcaactcgggcggactgattgccgtggagcagctgatccgggagcagtttggcgtcttcatgtacaacgatggcaagggccaggtgataaaccgtgctgagtttctgcgctggaagtaccgcgaccacaccgaggtgaccatacccattgaggcatccctgtccatccacgatccgctgggcaaatgggaggaccacaaggcctgctggcagatgcagtaccgcggcgccctgggcgagagtctgctccatgtgctcatcatctgcgattccaaggtgcacaccaagttggcgcgcgtgctgctccgcgtgttccccaatctggcgctggatgtgatggagggcgaggagtatctgggtgctagtgccctgcacctgtcgattgcctacagcaacaatgagctggtggcggatctgatcgaggccggagcggatatccatcagcgagcgattggtagcttctttctgccacgtgaccaacagcgagcgaatccggccaagagcaccgactacgagggactggcctacatgggtgaatatccgctggcttgggccgcctgctgtgccaacgagagtgtctacaacctgctggtggactgcggatccgatccggatgcccaggactccttcggcaatatgatcctgcacatggtggtcgtgtgcgacaaactggacatgttcggctatgccctgcgacatcccaagacgccggccaagaatggcattgtcaaccagacgggactgactccactcactctggcctgcaagctgggacgggcggaggtctttcgtgaaatgttggagctgtccgcccgcgagttttggcgctacagtaacatcacctgttccggctatccactgaatgcactggacactcttctgccggacggaaggactaattggaattccgccttgttcatcattctgaacggcaccaagccggagcatctggacatgttggacggcggcattatccagcgcctgctggaggagaagtggaagacctttgcgcagaaccagtttctgaagcgtctgctcatcctgtccacccatctgctatgcctgtccgtatcggtgtatttgcgtccagcgcacgatggtgaagccgaggatgaggactccgagggatcggatgcctcggcagccgctctgctggacatacagtcggatgagggcgacagtggtggtggtgactacaatgcccagacggtggcccgttactgcgccgagtttgccaccctggtgggagttttaagctatgtgatcttccagcaaggcgacgagataaagaaccagggtttgtccgcctttctcaagcagctgtcccatgcgccggctaaggccatcttcctgttctccaacttgctgatcctggcgtgcattccatttcgtttgattggcgacaccgataccgaggaggccatcctgattttcgctgtgccgggctcctggtttctcctaatgttctttgctggtgccattcggctgacgggtccgtttgtgaccatgatctattccatgatcacgggcgacatgttcaccttcggcatcatctactgcatcgtcctgtgcggattctcgcaggccttctacttcctctacaagggacatccccaggtgcagtccaccatgttcaatacctacaccagcacttggatggccctgttccaaaccacactgggtgattataactatcccgatctcaatcagaccacatatcccaatctctccaagaccgtgtttgtcatctttatgatcttcgtacccatcctgttgctcaacatgttgattgccatgatgggcaacacctatgtgactgtgatcgagcagtcggagaaggaatggatgaagcagtgggccaagattgtcgtcaccctggagcgcgctgttccgcaggcggatgccaagggctatctggaggcatactccatcccgctgggtccgtccgatgactccggtttcgaagtgcgcggcgtgatggtcatcaagagcaagagcaagacgagggccaagcagcgaaaaggagccgtctccaactggaagcgcgtgggtcgtgtgacgctaacggcgctcaagaaacgcggaatgaccggcgaggagatgcgtcgccttatgtggggccgtgcctccatctccagtcccgtgaaagtgacgaagcagaagcttaaggatccctacaatctgcacacggactccgacttcaccaacgccatggacatgctgaccttcgctagcaacccggcttcctccaatggcgtcaccctgcgatcggtaacagcgcctccgcccgcaccgccagcaccggatcccttcagggagctgatcatgatgtcggaccagcgaccggagacccatgatccccactactttgccggcctgcagcagctggccaataaggctttcgatttggtggagcaaacgatgaagacacagccgcaagcgccggtggccaagaaggtggatccactgccagtggcttcggtggccaaagcatctccagccgctcctgcaacacaagctactgctactgctgctgctgcttccgatctaatggccatgccactgcccatttcgaacttgagcaatcttttccaagaccccaaggacattgtcgatcccaaaaagctggaggagttcatggccatgctggccgaggtggaaaccgaggagagcgacagcggcggacccattctcggcaagctatcgctggccaaacggacacacaatgccctatccaaggcggaaattcgacgggatcagcagggattcgagggtcacagccatggacagtttcagcccatgtcctcggtgtgggcaccacctggcctggatgtggacacgggcttccacttcgatgaagccgtcgcggaggaggtgctgaccatcgaacaggaagccgaagtggagaccgaggacggcaatggtggacaggacagcgaggatatacccacggcggaggaggtgcacgccactatgaagcagtttcacctgcgcaagtgccagccagcacaggatgaggccgctcgtcgcgccaaaagtgctcgtgttcgtcgccgaaacaaagtttcgccggagcaaagcgatgatccggacgagcgcagccagcggggacgttccgcttacacgcggcgaacgcaatcgccgcccgatccgctggaaccatggagcacccgcgaactgcaggacatcaacaagatcctggccagaaagtga

SEQ ID NO: 29 - DNA, 3387 bp, Musca domestica
atgaggctgttcatgaaaaagtgtttgagaaaaaagcctcaggaattgaaacctggagcgattttagatgctgtcatttcacagtcatcggcaacagctagcaaatgtttgctctacaagttggcggactacaaacggggaggcgacctcattgatgccatcaacaccggagggctggtggcggtggaacaactgattcgcgaacaatttggcatattcatgtataacgatggcaagggtcaggtcattaatcgtgccgaattcttgcgttggaaatatcgtgaccacaccgaagtgaccatacccatagaagcctctttatccatacacgatccattgggtaaatggaaggatcacagtgcctgttggcagatgcagtatcgtggcgccttgggagagagtctgctgcacgtcttgattatttgcgattccaaaatgcataccaaattggcgcgtatcttgttgagggtgtttcctcgcctggcattggatgtcatcgagggcgaggagtatttgggtgcaagtgcattgcatttggccatagcttatagcaataatgagttggttgccgatttaattgaggcaggagctgacatcaatcagagagccattggaagtttctttttgcccaaggatcaacagagagccaatccggcaaagagtacagattacgagggtttggcttatatgggcgaatatccattgtcatgggctgcctgctgcgccaatgaaagtgtctataatctgttgattgatcatgatgccgatcccgatgcccaggatagttttggaaacatgatcctgcacatggtggtggtgtgtgataagttggacatgtttggatatgctctacgccaccccaagactccggccaaaaatggaattgttaatcattctggtctgacacctctaacattggcttgcaaattgggtcgggctgaggtgttcagggaaatgttggaactatcggccagagaattttggcgttatagtaacattacctgttcgggttatcctttgaatgctttggacacgctgctaccagatgggaggaccaattggaattcggccttgtttattattttgaacggtaccaaggaggaacatttggatatgttagatggtgggattatacagcgtctgctggaggagaaatggaagacctttgcccagaatcaatttctaaagcgtttgctgattttggtggtgcatttgttgtgcctctcaacgtcggtgtatctgaggccagcccatgatggcgatgatgacgaagaagatgaaacggctcaggctaatgcaggactacagaccaatgatccagaaaacgaagaatatgatattcaaacaatagtgagatattgtgctgagctgtgtaccattgcgggggtccttagtttcctgattttccaacaaggcgatgaaataaagaatcagggattgtcagccttcctcaaacaactgtcccatgctccagctaaggtaatattcttggtctcgaatctgatgattttggcctgcataccctttcgcctaatgggtgacacggacacagaagaggccatacttatatttgctgtgccgggaagttggttcttgctgatgttctttgcgggtgcaattcgtttgaccggtcccttcgtaaccatgatctactccatgataacaggtgacatgtttacgtttggcattatttactccattgttctgtgtggcttttcccaggcgttttatttcctttacaaaggacatccccaattgcagtcgactatgtttgatacctttcccagcacctggatggccctgtttcaaaccactttgggagattacaattatcccgatttgaatcaaacaacctacccgaacttgtcgaaaaccgttttcgttattttcatgattttcgttcccattctgttgctgaacatgttgatcgccatgatgggcaacacctacgcccatgtcattgaacaatccgaaaaggaatggatgaaacagtgggccaagattgtggtcacactggaaagggcagttccccaagcggatgcaaaaaattatctggaagcctattccatacccttgggtccttcggatgattccggatttgaggttaggggagtaatggtcattaagagcaaaagtaagacaagagccaaacaacgcaagggagcagtatcgaattggaagagagtgggccgtgtaacgctcaatgccttgaagaaacgtggtatgacgggtgaggagatgcgtcgtcttatgtggggccgagcatccatatcgagtcccattaaagtggccaagaagaaactgaaggatccctacaatctaaatcaagagcctgggggtcaatccaatttgaccagtgccatggacatgcttaattttgccaatgacccagcctccagctcgggattggcttttagaacttctggtactcaggaccccaaggagaagaaggatgtgccacacattcccgcaccagatcccctgcgtgatttggttctgttagccgaagagaagccggaagtacacgatccacaattctattcagcattgattcagttggccaacaaggcctatgatttggtgaagaaaaccctggaaacccaacatcagccacaagttgaggagccgataccactcacagaggccaccagtttgaaggacgtcacactgacaaaacaacccgatcccgttgctgctgatgctggactccttggcgacatggccatgggtgccaatcttaccaatctctttcaagaccccaaagatattgtggacccaaagaaactcgaacaatttctgaaaatggtagctgatgttgagaccgaggaaagtgatggaggtggtccaattttgggaaaactttcattggcccgcaggacacgcaatgccctatttaaggtacccatacccaagagtactcttggcgacagttcggataagttaattaattcggtgtgggacaaggtgccagccgacaatgatgaggacagtattccggcctttgatttccaagaagctctggctgaacatgtcctgacagtggaacaagaggccgatgtggagaccgaagatgcaaacgatgattcgggtgagaccatggacgatatacccacagcggaggaagtacacgctaccatgaagcaatttcatttgcgtaagcgtcaatatcagcaggacgatgcagcacgtcgtgctaagacggctcgaataaggcgcaagaataaagttgctccagattatgctgggagtgaagagcaatatggacgtggccgttcggcacccatgaaaaagaaacatgatgaggatgaaatgtcacctcctgatcccttggaaccatggagtactcgggaattgcaaaatattaataaaatcctggcaaaaaagtaa

SEQ ID NO: 30 - DNA, 3435 bp, Ceratitis capitata
atgaaattctttttgaaaaaatgtctacgcaaaaaaccggaggagatgaaaccaggcgccatactggacgccgtcatttcgcaatcctcaccaatggccaacaaatgtctactctacaagctggccgactacatgcgcggcggtgacctcatcgacgcactgaacactggcggcctggtcgccgtggaacaactgatacgcgagcagttcggcatatttatgtataacgatggcaagggacaggtgattaatcgtgccgagtttttacgctggaaatatcgcgatcacactgaagttactataccgattgaggcttcgctctcacgtcacgatccgctgggcaagtgggaggatcataaagcctgttggcaaatgcaatttcgtggggcactcggtgagagtttactgcacgtgctcatcatttgcgattcgaaaatacacacaaagctagcgcgggtactgatacgagtctttccgaatctggcacaagatgtgatggagggtgaggagtatttgggtgctagtgcgttgcatttggcgattgcttatagcaataatgagcttgtggccgatttgattgaagcaggcgctgatataaatcagcgtgctattggcagtttctttctgccgcgtgaccagcaacgtcgaaatccagccaagtcgacggactatgaaggattggcgtatctgggcgagtatccgttggcatgggcggcatgttgcgccaatgaaagtgtgtacaatttgctggtggactgtggtgcagacccagatgcacaagactcgtttggtaatatgatactgcatatggtggtggtgtgcgataaattggatatgttcggttatgctcttcgccatccaaaaacgccagccaaaaatggtatcgccaaccacagtggactcacaccgctgacactttcttgcaaactgggacgcgctgaagtttttcgtgagatgttggagctttccgcacgtgagttttggcgttacagcaacatcacctgctcgggttatccgctcaacgctttagatactttgctgccagatggacgcacaaattggaactcggcgctgtttatcatcttgaatggcaccaaagaggaacatttggatatgttggacggcggcatcatacaacgtttactggaagagaaatggaaaacctttgctcaaaatcaattcctcaaacgtctactgatcctagtcatacacttggttttcctctccatctcagtttatatgcgtcccgcgcgtgttgcagacgatgatgatgaagatgagatagatgcgtcttcgaaagacactaaagctcttgagcttgccacggaattggatgaagatgagtacgatgtgcagactattgtgcgctactgcgcagagtttggcactatagtgggcgtattgagttacgttatctttcagcagggagatgagatcaaaaatcaaggtttgccagcgttcttaaagcagttgactcacgctccagccaaagctatctttctagtctctaatctgctaattctcgcctgtataccctgtcgactcatgggtgatacggacgccgaggaggctatactcatctttgccgtgcctggcagttggtttctgctaatgttttttgccggcgccatacgtctgacgggtcctttcgttactatgatatactccatgattacaggcgatatgttcacgtttggcattatttattgtatcgtactatgcggcttctcgcaagctttctactttctctacaaggggcatccacaaatacagtcgactatgttcaatacctttcccagtacttggatggctttgtttcaaaccacactcggagactataattatcccgacttgaacaatacaacatatccgaacctctcgaagactgtattcgttatatttatgattttcgtgccgattttattgttgaacatgttaatcgctatgatgggcaacacctacgcgcaagttatcgaaagatcggagaaagagtggatgaaacagtgggcaaagatcgtggtgaccttggaacgcgctgtaccacaagctgatgctaagaactatctagaggcctattcaataccactcggaccaatagatgactccggatatgaggtgcgcggtgtaatggttatcaagagcaaggcgaagaccagagctaaacagcgtaagggtgcagtttctaattggaagcgcgttggtcgggtcacattgaatgcgttgaaaaagcgcggcatgaccggcgagcaaatgcgtcgtttaatgtggggacgtgcatccatatcaagtccgattaagattacaaaaaagaagttgaaagatccctacaatttgaatccacaaaatgatctcacaagcgctatggatatgttgacctttgccaatgatcccgcagcaagcgctggtctacaactacgctcctcactcatggactccggtgccgagggcaaagcagcaaaagtgcaggaggaaaatcagcaacccgcaccagatccactgcgcgacttaattttcctcgccgatcgtcgtccggaaatgcatgatcctcagtattttgttggcctacagcaattggcaaatcaggcattggatttggtagaacaaacaatgggcatccatccaccacccactcccgcaactgatgctttacttctatcagcagctgctgctacaacaactatcggtgcagtgacaatgcaaacagccacaactgttgccgcaccgagcgcagatttaattaccccattgggcgcgaatttaacaacgctctttcaagataacaaagatgtcgtggatccgcaaaagcttcaagaattcttgaaaatgttggccgagatcgagaccgaggagagtgatggcggtggtagaccaattttgggcaagttatcgctttctcgacgtacaaagagcgctctttcgaaggctcagattaagaaagatacggtcggtggtagtcctgataaattgatcccatcggtttggtcacataatttaccgcaaccagatgaggaaccggaattcaacttcgaggctgcactagccgaggaacacacactcaccattgaacaggaggctgaggtggagaccgaaaccggcaacgagcgtgaggatagcgaagattgtccgacggtagaggaggtgcatgcaacaatgaaacaattccacctgcgtaagcggcaatatcaacaggacgacgcagcacgacgagcgaaaagtgcacgcatcaagcgcaaaaatagaatttcaccggaacaatcccatgagtgtgatgacggcagcagcggcggcggcggaggtaagtcaacacacccacgcggcgcttcagcgccaggccgtaagcacacggtgagcgaacgcttgtcgccgccggatcctctggagccgtggagtacgcgcgaattgcaaaatatcaacaaaatattagcgcgcaagtga

SEQ ID NO: 31 - DNA, 3363 bp, Aedes aegypti
atggtccaattcgactggcggcgtatgtgtcgcaagaagcgaaaggttcctcagggcggtgctatcctggatcaagtgatttcccagtcggccaatgcttctaatcagtgcttgctgtataagatggctaattacaaacggggtggagatttgatcgatgcgttccaggtcggagggcagaaggccgtggagcagttgattcgggagcagtttggagtttttatgtacaacaatggccgcggacagatcatcaatagggccgagtatctacggtggaagtacatggataatcatgaggtcgtcatcccgattgaggcgtcgttgtctccgcatgatcctttgggcaaatgggtcgatcataaggcctgctggcagatgcagtatcgtggattgctgggcgagagtttgctgcacgtgttgatcatctgcgatacgaagattcacacgaagttggcccgcatcctgctgcgcgtgttccccgagctgtcgatcgacgtgatggaaggcgaggagtacctgggcgctagtgcactccacttggcgatcgcgtacagcaacaacgagttggtgggcgatctgatcgatgccggagcggacgtgtcccagcgcgccatcggacggttcttccttccacgggatcagcagggcttgaagccggccaagaacaccgactacgaggggttggcctacttgggcgagtatccgctggcgtgggccgcctgctgcgccaatgagtccgtctataacctgctgctggaatgcggggcggatccgaacgcgcaggacagcttcgggaacatgattctgcacatggtcgtcgtctgcgataagctggatatgttcgggtatgcccttcgtcatccgaagcttccctgtaaaaatgggatcgtcaatgagtccggactcacgccgttgaccttggcctgtcgattgggtcgtgatgaagtgttccgtgagatgttggagttgtcggcgagggagttttggcggtacagtaacatcacctgttccggatatccgttgaacgcattggacacgttgatgcccgacggaactaccaattggaattcggcgctgtttatcatcctcaacggaaccaaggaagagcatttgaacatgctggacggtggcatcgtggaacgtctgctggacgagaagtggaagacgttcgctcggaaccagttcatcaagcgactgctgatcctcgctctgcatctgttctgcttgtcgtgttcggtctacttgagaccggtgcgagttttcaaggaggagagtgaagagggaagcgatggaggagatggagcgggtacagctgctccggacggtgtcgatgatgatgaggacattgatttgacgacctggttccggtatggattcgagatcgcaaccgtgatgggagtactgagctacgtggttcttcaacagggtgatgagatcaagaatcagggattgatctcgtttataaagtcacttggaaatgctccggcgaaagctatcttcctgatctccaatctgatgatcttggcttgcatcccgttccgaatgatgggtgacgttgaacacgaggaggccattctgttgttcgcagtcccaggatcatggttcctgctgatgttctttgctggcgccatcggcttaacaggtcccttcgtcaccatgatcttctctatgatcacgggtgacatgttcaccttcggcatcatctacatgatcgttctgttcggattttcccaggcgttctacttcctgtacaaaggtcatccggaagcggaggattctccatttgggagctacttcggcacttggatgggcctgttccagacaaccctcggcgattacgattacgccgacttgaatcttacgacctacccgaacctggcgaaaaccgtgtttatcatattcatgatcttcgtgccgatcctgttgttgaacatgttgatcgctatgatgggcaacacctacgcgtacgtcattgagcaagctgaaaaggaaggcatgaaacagtgggccaagatcgtggtcaacctggagcgggcggtcaagcaggaggacgccaaaaagtacctggaggagtactcgatcgggttgggaccgtcggatgatccgaggtacgagatccgtggagtcatggtcatcaagagcaagagtaagacccgtgccaggcagcgcaagggagcggtaagtaactggaagagcgttctgcgtgtcacgttgaacgagctgaagaagcgtaacatgaccggcgaggagctgcggaggatcatgtggggacgatcgtcgatcacttctccggccaagatctccaagaagaaaaagatctacgaagaggaggaccccttcgccatcaccaatgctatcgatgtgatgtccttcacgcaggacatcgtcatggtaagtagcgaaccgaccggaccgcccacaatcgacccctccaaaccggcgacgatcgccgtcaagccccaaacggcacccgcagcgcaaccgatcccggagattcctcctcaaccgccgctggtcaaacggcagtccgtggttagtgctccgccggcctacgacgatttccccccgatgaaggactacaaggatcccctgcgggagctggtcatcatctcggagtcgccctcggtggacgaccattacgtgcagagctgcaagaccctcgcgaatgatgcgtccaccctggatcacgacaccttgggtcagttaaatcccttcctggaggcgaaggacgtggtcgatccggtgaaggaacgcgagtttctcaaaacactggaggccctggaggacaccgacagcgaagcggccgaaaagccggtcctgggcaagatctccctgatacgacgcgccaagtcagccgtctcgagaaccacttccaggaagaagaaaaccgaccagcatccgctgtttacgatcgcttgggatgacaagaacctgacccggacgcatccggaggactttggagcgctgaacacggcctacgagtacagtgccgaagatttcaagcaagacgtggacgaggaagcgagggaggaggaggaagacgagggtgtgacggtggaggaagtgcaccgccgaatggaagagctacaccatcgcggccgggcttccttggagcgggacagcaactcgaccgagagcagcaagaaacatccgcacaggaagcggcaaggtatgggccgaggtcggaacaacaaggtgtcgccggatacgtccaacgagagcgtatccggcaagaaggacaaacggatgaagtcggcgccgacgggtggagggacctcgccaccggatccactggaaccatggagcacaagggatatttgcaacattaataaacttttggacaccgatacgcaggatgagtaa

SEQ ID NO: 32 - DNA, 3414 bp, Culex quinquefasciatus
atggttaagttcgactggcggcggatgtgccgcaagaagaagaacgttccgcagggtggtgctatcctggatcaagtgatttcgcagagcacgaacgtccagggccagtgtctgctgtacaagatggccaattacaagggtggtggcgatttgatcgatgcgttcaagatgggcggccagaaggcggtggagcagctgatccgggaacagtttggggtgtttatgtataatgctggccggggtcagattatcaatcgggcggagtatctgcggtggaagtatatggataaccatgaggttgtgattccgattgaggcgtcgctgtccccgcatgatcctttggggaagtgggtcgatcataaggcctgttggcagatgcagtatcgtgggttgctgggggagagtctacttcatgtgttgatcatctgcgacactaagattcataccaaactgtcccgcattctgctgcgcgtgtttccggagctgtcgatcgacgtgatggaaggcgaggagtacctgggcgctagcgcactccacctggcgatcgcgtacagcaacaacgaactcgttggcgatctgatcgacgccggggcgaatgtgtcccagcgggccatcgggcgcttcttccttccacgggaccagcagaagatgcatccggccaagaccaccgactacgaggggttggcctacctgggcgagtacccactggcttgggccgcttgctgctcgaacgaatcggtctacaacctgctgctcgagtgtggcgcagatccgaacgcgcaagacagcttcggaaacatgatcctgcacatggtcgtcgtgtgcgacaagctggacatgtttgggtacgcgctgcggcacccgaagctaccatgcaagaacgggatcgtcaacgaggccggactgaccccgttgacgctggcctgccgcatcggtcgagacgaggtgttccgtgagatgttggagctgtcggcgagggagttttggcggtacagtaacatcacctgttccgggtatccgttgaacgcgctggacacgttgatgccggatggttcgacgaactggaactctgcgctgttcatcatacttaacggaacaaaggaggaacatttgaacatgctggacggtggtatcgtggagcgtctgctggacgagaagtggaaaactttcgccaggaatcagttcttgaagcgtttgcttatccttgcactgcacttgttttgtctgtcgtgctcgatttacctgcgaccggtacatgtcttcaaggatgatgacgatgcagatgacaccgatggggttactgattcccctgatacaaccgacgacgaggggattgacctgaccacgtggttccggtacgggtttgaagttgccaccgtgatgggcgtgctgagctatgtcgtagttcagcagggtgaagaaatcaagaatcaggggtttatatcgttcctcaaatcgctggctggagctcccgctaaagcgattttcttgatttccaacctgatgattttgtgctgcatacctctgcggattctcggcgatagagaagctgaggaagcggtgttgttgtttgccgtccccggcagctggtttctgttgatgttcttcgccggtgcaatcggactaactggacccttcgtaaccatgatcttttctatgataaccggtgacatgttcacctttggtatcatttacacgatcgtactgttcggattctcgcaagcgttttacttcctgtacaagggtcatcccaacgcggacgaatcaccttttggcacgtactttggaacctggatgggactgttccagacgaccctgggcgattacgattacgccgatttgaacctgaccacgtaccccaacctcgccaaaacggtctttatcacgttcatgatcttcgtgccgattctgctgcttaacatgttgatcgccatgatgggtaacacctacgcgtacgtcattgagcaagccgaaaaggaaggtatgaagcagtgggccaagattgtggtcaacctggagcgtgccgtcaagcaggaggatgccaaaaagtatctggaagagtactcgatcgggctgggaccttcggacgatccacggtttgagattcgcggcgtgatggtcatcaagagtaagagcaagacgcgagcgcggcagcgcaagggagcggtcagcaactggaagagtgtgctgcgtgtgacgttgaacgagttgaagaagcgcagcatgactggcgaggagctgcgccggattatgtggggtcgatcgtcgatcacttccccggctaagatttccaaaaagaagaagatctacgacgaagacgaggatccgttcgcaatcacggcagccattgacgtgatgtcgttcacgcaagatatcgtgatggtcagtacggaaccggttggtcccctcatgatcgacccgacgaaacctcccgtcaccaccgtcaaacctaccgctccgaccgttccttctgcgcaacctgctccaggcgttccgatgacaacagcgcagactgcggctcctacggcaccccagctggtcaagcgccagtccgtggtcagtgctccgccggcttacgatgacttcctcccggcgaaaggcttcaaggatccgctgcgggagctgctcatcctttcagaatcgacctcgatagacgagcactacgcgcaaacgtgccgttcgctggcgacggatgcctctaccctggaccacgaggaacaccagcaacagcaacagcagaccgttggccagttgaatcccttcctggacgcgaaagacgtggtcgacccagtgaaggaacgcgagttcctcaaaaccctggaagccctcgaagacaccgacagtgaagcggccgaaaagcccgtcctcggcaagatctcgttgatccggcgtgccagatcggccgtttcgagaacaacctccaggaagaagaaaaccgaccagcatccactgtttatgattgcctgggacgacaaaacgacgaccatccccggtgggggtccccaagcggtatcggccaccgccggaactgctgctccggaggatgactttggggcactgaacacggcgtacgagtgctcggcggaagatttgaagcacgacgtggacgaagaagcacgggaggacgatccagacgagggcgtgacggtggaggaggttcaccgacggatggagcggttccaccagcggccgggcagatcctcgccggaacgggacagcaactcgacggaaagcagcaagaagcaggccaagggagacaaacgcatgaagtcggcacccagcggccatgggccgcgccatcggcagatgatggacactggtggtggatcgccgccggatccactcgagccgtggagcacgaaggaaattgtaccgatcaataagctgctcgatacggatacccaggacgagtag

SEQ ID NO: 33 - DNA, 3651 bp, Anopheles gambiae
atggtgcatctcgatccgctgcggctatgccgcaaaaagcgcaaactaccgcagggaggcgccatcctcgaccaggtgatatcgcagtccgcgtccgcctcgaaccagtgtctcctgtacaagatggccaactacaagcggggcggcgatctgatcgacgcgttccagatcggcggccagaaggcggtggagcagctgatccgcgagcagttcggcgtgttcatgtacaacaagggccggggccagatcattaaccgggccgagtacctgcgctggaagtacatggacaaccatgaggtcatcataccgatcgaggcctccctgtcgccgcacgacccgctcagcaagtgggacgaccataaggcctgctggcagatgcagtaccggggcctgctgggcgaaagtctgctgcacgtgctcatcatctgcgacacgaaggtgcacaccaagctggcccgcatcctgctgcgcgtcttcccggagcagtcgatcgacgtgatggagggcgaggagtatcttggcgcgtccgccctccatctagccatcgcgtacagcaacaacgagctggtcggcgacctgatcgatgccggcgcggacgtgtcccagcgggcgaccgggcgcttctttctgccccgcgaccagcagggcctgcggccggccaagacgaccgactacgaggggctggcgtacctcggcgagtacccactggcctgggcggcctgctgcgcgaacgagtcggtgtacaacctgctgctcgagtgtggcgccgacccgaacgcccaggacagcttcggcaacatgatcctgcacatggtggtcgtgtgcgacaagctggacatgttcgggtacgccctgcgccacccgaagctgccgtgcaagaacggcatcgtgaatgcggccggcctgaccccgcttacgctcgcctgccggctcggccgcgacgaggtgttccgcgagatgttggagctttctgcgcgcgaattctggcggtacagtaacatcacctgctcgggctacccgctaaacgcgctggacacgctcatgccggacggcagcaccaactggaattcggccctgttcatcatcctgaacggcacaaaggaggagcatctgaacatgctggacggcggcatcgtcgagcggctgctggacgagaagtggaaaacgttcgcccggaaccagttcatcaagcggctgctcatcctcgcgatacacctgttctgtctgtcctgctcggtctacctgcgcccggtccgcgtgtttgctgatgacgagggcgaggagggcggagacgcaaccgatgacgatggtgcggacgatggtgggccgatggcggtggacgcggtcgacgacgacatcgacctgacgacctgggtgcggtacggcttcgaggtggccacggtgatgggcgtgctgagctacgtcgtactgcagcagggcgacgagatcaagaatcagggcttcttctcctttctcaagtcgctgagtcaagcaccggcgaaggcgatttttctgatatccaacatcctgatcctggcctgcataccgctgcgcatgatgggcgacaccgagacggaggaagccatcctgctgtttgccgtaccgggcagctggtttctgctaatgttctttgctggtgcgatcggactgaccggaccgttcgtgacgatgatcttctccatgattacgggcgacatgttcacgttcggcatcatctacatgatcgtgctgtttggcttttcgcaagcgttctacttcctctacaagggccacccgaacgcggaggacagcccgttcggcagctatttcggcacgtggatggcgctgttccagaccacgctcggcgactacgattacgccgatctgaacctcaccacctacccgaacctggcgaagacggtgtttgtcatctttatgatcttcgtgccgatcctgctgctgaacatgctgatcgcgatgatgggcaacacgtacgcgtacgtgatcgagcaggcggagaaggagggcatgaagcagtgggcgaagatagtggtcaatctcgagcgggcggtgacgcaggacgacgcgaagcgctacctggaggagtactcgatcgggctcgggccgtcggacgatccgcggtacgagacgcgcggcgtcatggtgatcaagagcaagagcaagacgcgggcccgccagcgcaagggcgcagtgagcaactggaagagcgtgctgcgcgtcacgctgaacgagctgaagaagcgcagcatgacgggcgaggagctgcgacgcatcatgtggggccgctcgtccatcacgtcgccggcgaagatcgcgaagaagaagcggccgggcgaggtggacgatctgctcggcgatccgttcgcgataacggccgcgatcgacgtgatgtcgttcacgcaggacatcgtgatggttagcacggacacggtctgcccgatcacgataccgccagcggctgccccgggcacggcggccccgaaggctggtggcaccaaaccggtagtagtggcaccgccgccgccagcagcagcaacagcagtacagcaaccaccgccgccagcgacgacgcggcgccactcgacggcaagcgcaccggccacgatggggctgggcgtggaggcggccctgcccggctacaaggatccgctgcgcgagctcgtcatcatctccgagtcggcctcggtcgacgagaactacgcgcagaacgtgaaaacgctcgcgatcgacgcgtccacgctcgaccacgtgcacgagatcgacatcagccagcaacagcagcaacagcagcaacagcagcagcaacagccccagcaaccccagcagcagcagaatctcggccagctgaccctcttccagaacccgaaggacgtcgtggatccggtgcgggagcgcgagtttctcaaaacgctcgaagcgctcgaggacacggacagcgaggcgggcgagaagcccgtcctcggcaagatctcgctgatccggcgggccaaatcggccgtctcgcgcagcacgtcgcgcaagcgcaaaaccgaccagcacccgctgttcatgatcgcgtgggaggacaagggcgaccagcagcggcacagcacagcgctgtacgatggcgcgacgggtgcggccccgtcggtcggtgcgcccggcgagctggggcagccggagcagcccgaggacgccgtcacggtcgaggagctgcaccggcggatggagcagttccaccagcgggcgtccgtgcgcgaacgggacgcgaactcgagcgagagcggcagcggcaagcagcacgccggcccgaaggcacggaagccgtcccaccatcgggacggtggcggctcccatcatcaccatgggctcgggcggggcaagcacaacaagatatcgcccgacaactcgaacgaaagtacgggcggtggcggcggtggcggcgccagtggccacgggcgcaagcaggacaagcgcatgaagtcggccccgatactgggcagcggcggtgcgggcagtgccggtagcagtgccggcgggcggacggtggcgcccggtggtgcccgaccggacgatggtaccgggtcgccgccggacccgctcgaaccatggagcaccaagaacatcatgaacatcaacaagctgctggaccaggacacgaccgaagagtag

SEQ ID NO: 34 - DNA, 3261 bp, Tribolium castaneum
atgggtgcaaaagtgtgcaaaccgtgtaaaaagcgcaaagccaacaccttccaagggggctccatcctcgaccgggtcatcagccaagcctcaaaccaagaccagtgcctcctttacaaattagcaaattacaagaaaggcggcgaactgatcgacgcgtacaaccaagggggccaagccgaggtggaaaaattaatacgcgagcaattcggccagttgatgtaccaggaaggcaaaggccagataatcaaccgctcggagtatctcaggtggaaatttcgcgaccacgagcaggtcattctcccaatcgaggcctccttgagccgatacgaccccctggccaagtggaacgaccacgaggcgtgctggcagatgcagttcagggggtctttaggcgagtctttgctgcacgtcctcataatttgcgacacgaaaattcacacaagactggcgcggactctgatcaagtgtttcccgaagctggccctcgacgttgtcgagggcgaggagtatctaggggcgagtgctttgcacctagcgatcgcttacaacaacaatgagctagtccaggacttggtcgaagctggtgctaacgtgaaccagcgcgccattgggagctttttcctcccgagggaccaacaacgccaaaaacccgcaaaacacaccgactacgaggggctcgcctacttgggggaataccctctggcctgggccgcgtgttgcgccaacgaaagcgtctacaatctgttgctggacagtggggcgcaccccgactatcaggacaattttggaaacatgatcttgcacatggtggtggtttgcgacaagttggacatgttcggctacgccttgagacacccgaaactaccggcaagcaacggaattgtgaataaagcaggtctaactcccctaacgctggcttgtaagctgggtcgggctgaggttttccgcgaaatgttggagctttcagccaaggagttttggaggtatagtaacatcacctgctcggcgtattttttgaacgctttggatacgctgctaccggacgggcgcacaaactggaattcggcccttttcattattttaaacggaaccaaggaagagcatttagccatgcttgacggtgggattatccaacgactgttggaggaaaaatggaaaacattcgcacggaaccaatttttgaaacggcttcttatcctcgttgtgcatttgttgtttctgtctttggcggtttacttgcgaccagacgacccagacgagtctcttctcacctggtctgatgatgttacactgatagctagatatgtgtgtgaagtgggcacgattttgggcgtcctcagttatctggttttgcaacaaggggacgaaatccgtaatcagggacttactgcgttcttgaaacaacaactgaattcacccccgaaattaattttcctcatttcgaatttcctaattttggcgtgcattccatgcaggttgtatggcgataaggaaaccgaggaggctattctgtgttttgcggtacctgggtcttggtttcttctcatgttttttgcaggggccgttcgtttgactggtccttttgtcacaatgatttacagcatgattaccggcgatatgttgacttttggcatcatttacaccgttttcttatttggtttttcgcagtcgttctatttcctgtataagggattccccggggtcaaaacttccttatacaacacgtacatgtcgacttggatggccttattccaaattactttgggcaattatgaatattctgagttgagtgccaccacatacccagcggtcagcaaaacagtctttgccatcttcatggtgttcgtcccaattttgctgctcaacatgttaatcgccatgatgggcaacacttacgcccatgtaatcgagcaaagcgagaaagaatgggtcaaacaatgggcaaaaatcgtcatcgccctggaacgggcaatcccacaatccgacgcccaacattacttacaagagtacagtatttcgctggggcccagtgaacaggaccccagtaccgaaaaacgcggagttttggtcataaaatcaaagagtaaaacgcgggcaaaacaacgaaaaggggccgtggccaattggaagcgggtgggcaaagtaacgataaacgcgctcaaaaaacgcggcttaaccggtgaagaaatgcgctgcttgatgtggggccgcgagtctattaatacaccggtcaaaacaaagaagcctgtgaaggacccactgctggacccgcaagggccgaatttaacgggtggcttcggcgatgctttaaccactgctttggatgtgatgacgttcacgcacgatttggatattgtgggggcttcccagggcctgaatttggccacgaaccctaaacccgtccctcccacaacaacagcgagtgccgtgactgtgaataaccagataaattcggctctgaacgcgcagcaaaaggccgtagctggggctggagttggtgctttggctatgataggcacagtgacccaactcaccgactctcaaggctacattatgcaaaacagtgtgaaaaaagaagaaaaaattgtcgcaactttggaggaccctttcagggaacttgtcataaacgctaatgacagtaactgcgacccggaaaaattaaaaatgcttgcgctatcggccgccaatttgaaagacgttgaagagttatcggtggccaagccacaaacgaaaagtgttaagagtctagcggggattttcgccgggactgagacttttgtgaggaaagttgaagaaacaataaagaagaaatatgcggctttggatccaagtgatagtgaaggttttggcgaacctccactattagggaaaatatccaggactagaagggccaaatcggcaaacttgcgcaactcttcagcgcgatctaaagcttcagataagaaaaaactggtcgcggggtcacagtcaagctccactgatacggtcaataacgaaattaatgaaaagaatatcgaaaattctgacttagactatgccgaagagaggatcaagctggtgaaagagtcgttaaagcaggtggttgacgttgcgcaaattcggccgattaacatcgatgtggccctcgaggagcaagtgtcggtcacaatttcggaaacgatgcgagtgcagggctccggggacggggccgaagtccagtcatccaacgtcaaaccaaagcgcaaaaaacggagcaaaacagccaaaaacaacaagtaa

SEQ ID NO: 35 - DNA, 3306 bp, Megachile rotundata
atgggtggtgtctgctcctgtcgaggtctcggtagccaggttaacgctggctcgattctcgatcgtgtgatcagtcaagcgagcgacgaggatcaatgtttgctatatcgtctggccaattacaagaagagtggcgagctgatagacgcgtacaatcaaggtggccaggcagaggtggaaaaattgatcagggaacagtttggtgtactgatgtacgcggacggcaagggtcagatgatcaatcgggcagagtatctgcgctggaaattccgggacctggaacaggtcgtgcttcctatagaagcttccttgtcacgattcgatcctctggctcaatggaacgatcaccaggcatgctggcagatgcaatacagaggttccctcggagaaaccctcttgcatgttctgatcatatgcgataccaggttacatacacggctggcgcgtatcctgctcaagtgctttccacgattggccatcgacgtagtagagggcgaggaatacctcggtgctagtgctctacacctggcgatcgcgtacaataataacgaactggtgcaagacctcgttgaagtgggtgcgattatttctcaacgcgcgatcggcagttttttcctacccagagatcaacaacgaatgaacccggccaagaataccgattacgaaggattagcctacttaggagagtatcctcttgcctgggccgcctgctgcgcgaacgagagcgtttataacttgctgctcgactccggtgcggatcctgacgaacaggattcttttggcaatatgatactgcacatggtggtagtttgtgataaactggacatgttcgggtatgccctccgccatccaaagcttccagctcgcaatgggatcgtgaatgccgctggactgaccccattgaccctcgcctgccagctgggtcgtgcagaggtcttccgggagatgttggaactgtctgcacgagaattctggcgctacagtaatatcacctgctcggcgtaccccctcaatgcactcgacacgctgttacccgacggcagaacaaactggaactctgcgctatttatcattctgaacggtaccaaggaggaacacttgaacatgctggacggtggtattattcagcgattactcgaggaaaaatggaagacctttgcgcggttacagttcttgaagcgtttgatcatcctggtatttcacctgacatcactgtctctggccgtctacttaagaccctcaaacctcgatacggttctcctgaagtggccagaggaagtaacagaagttggtcgaaccatagctgagtgtatcaccgtgctaggcgtcctgagttatattttagtgcaactgggcggtgaaatcatcaacatcggtgttctctcgttcctgaagcagctgagtcacgagcccgccaaactgatatttctgatcagcaacttgctcatactggcgtgcattccgtgtcgtcttgctggaaacaggcatgcggaagacgcaatcctcgtcgttgctgttcctggttcctggttccttttgatgttttttgctggcgctatccggctgaccggtccattcgtcaccatggtctacagcatgataaccggcgacatgttgaccttcggaataatctacatggttgtgctgttcggtttttgccagtcgttctactttttgtacaaaggctttccaggagtgaaatcatccctctatagttcctatcactcgacatggatggcactgtttcaagtaaccctcggcgattataactacacagatcttagttacacaacgtatccgaatttatcgaagatggtgttcactatattcatggtcctggtgcctatactactcctgaacatgctaattgccatgatgggcaacacttacgcacacgtgattgagcaaagcgagaaggagtgggtgaagcaatgggcgaaaatcgtggtctctctggagcgagcagtatctcaaaaagacgctcagaattatttgcaagaatacagtattaaattaggacctggagatgacccgaacaacccagcgtcggagcaacgtggtgttctggtgattaaaagtaaatcgaaaaccaaggcaaagcaacgcaaaggtgctgttgctaactggaagcgtgtcggaaaagtgacgatcaacgaattaagaaaacgtggaatgacgggagaagagttacgacgaataatgtggggtcgagcctctttttcgacaccagttagagtaagtccaaatgtagatgaacctcaggtttcagcggtaactgctggttttggggatgcattaacagcagcactggacgttatggcgtttgcccatgacttggacctctccactgccacagaatcgattcctactaatattgacgtaaaacaatcgaaaccaaaggttgtcagcagcgaacaaaccaaattaacgacaaataatcaagaaaaaccatcgataacagaaaaagctgccacggagatcgcgaataaacaagtaaacgctaaagatgagaccaataagaaacctaatgaagttgtcgacgttgagaaaatgaatgtgaagaatgcaaacaattcaagcacagttgaagagtatcatgatctgtttttggaatttgtgattgcttcggaaagtatgaacgatcctgaaacgctactaaaaatggcggaacgtgttgctgcagaatttgattcgtctgcgaatcccaaaataaatttgcaaattttggaacagttcacgatgacgaaaataccgatggaggaacaagctgcagctgttaagaaacaatattttatcgaatccagcgataacgattttggcggcgacaacttgctaggaacggtggcccgtttacgtagaataagatcagctaacagcagatttatcacggcacggagacattcacggcatgtcaatgacgacatgtcatcgacgtcttccgcatccggcgacggaaatcctcgataccagcagttgctaaacgacactgaagaggtaccgtcgaatcaacggaccgaaaatcgagatgagtcaatcgtggcgaacaaatcggaagtaaaacaaaacgatgctaactgcggatcgaggtgcaaagctcagaagcgtcgaccaaaaactgctagaaacagggtatcgccgaaggaaacggaggattccggccaaaggagaagagaatcgatggagcggaataaggcggtttcaccggcgacatcgcccaccgatccgctcgagccatggagcacacgcggaattaaagacatgaacacgatattggcttgggaggaaaatgtgccggacagtccttaa

SEQ ID NO: 36 - DNA, 3306 bp, Apis mellifera
atgggtggtgtctgctcgtttcgaggtcgcggtagccaggtgaacgctggctcgatcctcgatcgtgtgatcagtcaagcgagcgacgaggatcaatgcctgttgtatcgtctggccaattacaaaaagggtggcgagctgatcgagtcgtacaatcagggtggccagttcgaggtagaaaaattgatcagggaacagttcggtgtgttgatgtatgcggacggtaaggggcaggtgatcaatcgtgccgagtatctacgctggaaattccgagacctcgagcaagttgtgctccctatcgaggcttctttgtcgcagttcgatcctctggctcaatggaacgatcacgaggcgtgctggcaaatgcagtacaggggctcgctgggagagaccctccttcatgtcctgattatatgcgataccaggatacacacgcgagtggcccgtattctgctcaagtgctttccacgattggccattgacgtagtcgagggcgaggagtaccttggcgctagcgcgctccatctagcgatcgcgtacaacaataatgaactggtgcaagacctggttgaggcgggggcgatcatttctcagcgggcgataggcagctttttcctaccgagggaccaacaacgaacgaatccggctaagaatacggattacgagggattagcttatctgggggaatatcccctcgcctgggccgcttgttgtgcaaacgagagcgtttacaacttattactcgactctggcgctgatcccgacgagcaagactcttttggaaacatgatattgcatatggtcgtggtttgtgataaattggacatgttcggatatgctctccgtcatccgaagcttcctgctcgcaatgggattgtgaatgctgccggactgaccccattgacgctcgcctgccagctgggccgtgctgaggtctttcgggagatgttggaactgtccgcacgagaattctggcgctacagtaacatcacctgctcggcgtatcccctgaatgcgctcgacacgctgttgcccgatggcagaacaaactggaactcggcgctatttatcattctgaacggtacgaaggaggagcacttggacatgctggacggtggtattattcagcgattactcgaggaaaaatggaagacctttgcgcggttgcagttcttaaaacgactgatcatcttggcattccatctgacgtccttgtcgctggcagtatatctgaggccttccaacacagatgctcagctcttgaaatggccggaagaaatcacggaagtcgcacgcacgatcgccgagtgcatcacggtgctgggcgtgctcagttacattctggtccaactaggcggtgagatcatcaacattggtctcttgtccttcatgaaacagttgagtcacgagcccgccaagctcatattcttgatcagcaacctgctcatactcgcgtgcattccatgtcgtcttgccggtaataggcatgcggaagacgcgattctcatagtcgctgtgcccggctcttggttccttctcatgttcttcgctggggctgtccggctgaccggtccattcgtcaccatggtgtacagcatgataacgggagacatgttgaccttcggtataatatacatggtggtgctgttcggcttctgccagtcgttctactttttgtacaaaggattcccgggagtgaaatcatccctctacagttcctatcactcgacctggatggcactgtttcagataaccctcggcgattacaactacacggatctcagctacacgacctatcctaatttatcgaagatggtgttcgccatatttatggtactggtgcctatactattgttgaacatgctaatcgccatgatgggcaacacatacgctcatgtgatcgagcagagtgaaaaggagtgggtgaaacaatgggctaaaatcgtggtttctctggaacgtgcagtctcacagaaggatgcacagaattatttgcaagaatatagcattaaactgggacctggagatgacccaaacaatcctgccgcggagcagcgaggagttttgattattaaaagtaaatcgaaaaccaaggcgaagcaacgcaaaggcgcggtagctaattggaagcgtgtgggcaaagtgacgataaacgaattaaaaaaacgtggtttaacaggagaggaattgcgacgaattatgtggggacgagcttctttttctacacctgtcagagtaagtccaaaaggggtcgagcctcaagtttctgtggtgaccgccggtttcggggacgcattgaccacagctttggatgtcatgacgttcgcccacgatctcgacttgtccaccgcaacggaaggaattccaaccaacatcgatgccaagcagtcgaaaccaaagagtgctaccaaggagacgaaatcgacggtgaataatcagcagaacgtgacgacaaacatagaaccattgaaatcgaccacggaaaatgtggacgatcaggcgaacaatcctagggaaaaaaaagtaactagccaagctgcgaccgtacacgagatgaatttgaagaatgcgaatcattcgagcgtgaccgaggattttcaggatccgcttttggaacttgtgattgcttccgaaaatacgaacgatcccgaaaccctgctcgaaatagcgaaacgtgccgcggcaggcttcgaaacagaaaccagctctaaaataaatcttcaaattttagaacaattcacgatgacgaagatacccatggatgagaaggtcaacgttacgaggaaacaatatttcgtcgaatccagtgacaatgactttggaggcgacaacttgctcgggactgaggcccgtctacgtagaataagatcagcgaacaacagatttatcacgacacgtagacggtcacggaacgtcgacgacgacctgtcatccacatcttccacgtctatggacagaaatcctcgatatcagtcgttgctcaacggccatgaaaactcgatcgaccgtccaatcgagagtcgagagtgttccatagaagcaattaactcgcaaataaagcagaacggaccgtgcgaaacgatgaaggccaaggtccagaagaaaagaccaaaaacggccagaaatagggtatcgccgaaggaaatagagaaggctggtccgaggagaagagaatcgatcgagcggaataaggcggtttcaccggcaacatcgcccacggatccgctcgagccatggagcacacgcggcattaaggacatgaacacgatattggcttgggaagagaccgcgccggacagtccttaa

SEQ ID NO: 37 - DNA, 3318 bp, Apis florea
atgggtggtgtctgctcgtttcgaggtcgcggtagccaggtgaactctggctcgatccttgatcgtgtgatcagtcaagcgagcgacgaggatcaatgtctgttgtatcgtctggccaattacaaaaagggtggcgagctgatcgagtcgtacaatcaaggtggccagttcgaggtagaaaaattgatcagggaacaattcggtgtattgatgtatgcgaacggtaagggccaggtgattaatcgtgccgagtatctacgctggaaattccgagacctcgagcaagttgtgctccctatcgaagcttctttgtcacagttcgaccctttggctcaatggaacgatcacgaagcgtgctggcaaatgcagtacagaggttcgctaggagagactctcctgcatgttctgattatatgcgataccaggatacacacacgagtggcgcgtattctgctcaagtgctttccacgattggccattgacgtagtcgagggtgaggagtaccttggcgctagcgcgctccatctagcgatcgcgtacaacaataatgaactggtgcaagacctcgttgaggcgggagcgatcatttctcagcgggcgataggcagctttttcctacccagggaccaacaacgaatgaatccggctaagaatacggattacgagggattagcttatctgggggaatatcccctcgcctgggccgcttgttgtgcaaacgagagcgtttacaacttattactcgactctggcgctgatcccgacgagcaagactctttcggaaacatgatactgcatatggtagtggtttgtgataaattggacatgttcggatatgctctccgtcatccgaagcttcctgctcgcaatgggattgtgaatgctgccggactgaccccattgacgctcgcctgccagttgggccgtgctgaagtctttcgggagatgttggaactgtccgcacgagaattctggcgctacagtaacatcacctgctcggcatatcccctgaatgcgctcgatacgctgttgcccgatggtagaacaaactggaactcggcgctatttatcattctgaacggtacgaaggaggagcacttggacatgctggacggtggtattattcagcgattactcgaggaaaaatggaagacctttgcgcggttgcagtttttaaaacgactaatcatcttggcattccatctgacgtccttgtcgctggcagtgtacctgagaccttccaacacagatgctcaactcttgaaatggccggaagaaatcacggaagtcgcacgcacgatcgccgagtgcatcacggtgctaggcgtgctcagttatattctggtccaactaggtggcgagatcatcaacattggtctcctgtccttcatgaaacagttgagtcacgagcccgccaagctcatattcttgatcagcaacctgctcatactcgcgtgcattccatgtcgtcttgccggtaataggcatgcggaagacgcgatactcatagtcgctgtgcccggctcttggttccttctcatgttcttcgctggggctgtccggctgaccggtccattcgtcaccatggtgtatagcatgataacgggagacatgttgaccttcggtataatatacatggtggtactgttcggcttctgtcagtcgttctactttttgtacaaaggattcccgggagtgaaatcatccctctacagttcctatcactcgacctggatggcactgtttcagataaccctcggcgattacaactacacggatctcagctacacgacctatcctaatttatcgaagatggtgttcgctatatttatggtactggtgcctatactattgttgaacatgctaatcgccatgatgggcaacacgtatgcccacgtgattgagcagagtgaaaaggaatgggtgaaacaatgggcgaaaatcgtggtttctctggaacgtgcagtttcacagaaggatgcacagaattatttgcaagaatatagcattaaactgggacctggagatgacccaaacaatcctgcctcggagcaacgaggagtcttgattattaaaagtaaatcgaaaaccaaggcgaagcaacgcaaaggcgcggtggctaattggaagcgtgtgggcaaggtgacgataaatgaattaaagaaacgtggcttaacaggagaggaattgcgacgaattatgtggggtcgagcttctttttctacacctgtaagagtaagtccaaaaggggtcgagcctcaagtttctgtggtgactgccggtttcggagacgcgttgaccacagctttggatgtcatggcgttcgcccatgatctcgacttgtctaccgcaacggaaggaattccaaccaacatcgatgccaagcagtcgaaaccgaagagtgctatcaaggagcagatgaaattgacgacgaataatcaggagaacgtgtcgactaacgtagaaccgcagctgaaatcgaccacggaaaatgcgaacgatcaggcgaacaatcctagggaaattaaaaaagtaactaaccaggttacaggcatacacgagatgaatttgaagaacgcgaatcattcgagcgtgaccgaggattttcaggatccacttttggaacttgtgattgcttccgaaaatacgaacgatcccgaaaccctgctcgaaatagcgaaacgtgccgcggcaggcttcgaaacagaagccagctctaaaataaatcttcaaattttagaacaattcacgatgacgaagatacctatggaggagaaggtcagcgttacaaggaaacaatatttcgtcgagtctagtgacaatgactttggaggcgacaacctgctcgggactgaggcccgtctacgtagaataagatcagcgaacaacagatttatcacgacacgtagacggtcacggaacgtcgacgacgacctgtcatccacatcttccacgtccatggacagaaatcctcgatatcagtcgttgttcaacggccatgaaaactcgatcgaccgtccaatcgagagtcgagagtgttccatggaagcaattaactcgcaaataaagcagaacgggccaccgtgcgaaacagtgaaggccaaggtccagaagaaaagaccaaaaacggccaaaaatagggtatcgccgaaggaaatagagaaggctggtccgaggagaagagaatcgatcgagcggaataaggcggtttcaccggcaacatcgcccacggatccgctcgagccatggagcacacgcggcattaaggacatgaacacgatattggcttgggaagagaccgcgccggacagtccttaa

SEQ ID NO: 38 - DNA, 3168 bp, Pediculus humanus
  source: /note="Pediculus humanus corporis"
atgggagctggattatgtggaacttctcaagatcctcaaaatcaaggttcggttttggatagagtcatttctcaagcttctaacaaagatgattgtcttttatataaacttgccaactacaaaaacagtggagaattgatcgaagcatacaatattggaggtcaagctgaggttgaaaaactgattaaagaacaatttggagttttaatgtatgccgatggcaaaggtgaagtaattaaacgtgcagaataccttaggtggaaatttcgagatcaagctcaggtcgttttacctatcgaagcttctttatctatttacgatcctttggcaaaatgggaagaccacgaagcttgttggcaaatgcagtacaggggtagtttaggagaaacgcttcttcatgttttgataatttgcgattctaaaatacacacaaaacttgctcgtacccttttaaaatgctttcctaaacttgctttggatatagtagaaggagaagaatatttgggagctagtgctcttcatttagccattgcttataataataacgaattagttgaagatttggtagatgctggagccaacattaatcaaagagcagtaggtagtttttttcttcctaaagatcaacaacgagcaaaacctttaaaaaccacagattacgaaggtttggcatatttaggagaatatcctttatcgtgggcagcttgctgctcgaatgaaagcgtctacaatttacttcttgatgtcggtgccgatcctgacagtcaggattcttttggaaatatgatattgcacatggtggtcgtttgtgataaactggacatgtttggttatgctcttcgtcatccaaaagtaccagctagtaatggaataattaacaacgagggacttactcccctaacattggcatgtaaattgggtagagcagatgtttttaaagaaatgttagaactgagtgctaaagaattttggcgttacagcaacatcacttgttcggcatatccactaaatgcacttgacactctattaccagatggaagaaccaattggaattctgcaatttttattattttaaacggtaccaaagaagaacatttagacatgttagatggtggaataatccaaaggcttttggaagaaaaatggaaaacttttgcaagaaaccaatttttaaaacgtttggttattttcttcttacatatattttgcctaagtggttctgtatatttaagaccggacgatagaaataaaccacttttgggtggtacttccgttcaagatgttgtcaggtattgtttcgaaatcggtaccatactcggagttctttgttatttatgttttcaacaaggagatgaaattagaaatcaaggattgattagttttttaaaacaattgccgcatgatcctgcaaagtttatatttctcatatcaaatcttttaattttggcctgtataccttaccgtgtggctggtgatacggatacggaagaagccatacttgtatttgcggtacctagttcgtggtttctgttaatgttttttgccggagcgattcgattaactggtccatttgtcaccatgatttacagtatgatcactggagatatgttaacctttggtattatatattcggtatttttatttggtttttctcaaagtttttttttcctatacaaaggctctaaaaatgtgagcagttctctatttacttcatatccatcaacttggatggctctttttcaagtcacaatgggagattataactacaatgatttatctctaacagcatatccagccattagcaaaatggtattcacaatatttatggttttggtacccattcttttgttaaacatgttgattgccatgatgggcaatacttatgctcatgttattgaacaaagcgaaaaagaatggatgaaacagtgggctaaaattgttgtggctttggaacgtgcggtaaatcaggaagattgtcatcgttacttacaagaatattctattaaattaggtcctggtgatgatcctagcaccgagcaaagaggtgttttggtaattaaatctaaaagtaaaacaagagcaaaacaaagaaaaggcgcactttgtaattggaagagggttggaaaagtaaccattcgagaattgcataagagaggaatgaccggagaacaattgcgacgtcttatgtggggaagatcatcaatttcaacccccgtcaaacctgcaccaataaaattaggccacgttacgagcatctcgggtgtggctgatataaccgttccagaaacgacaggaaacactgttggaacgggaggaggcggtttgttagctgctttggacgttatggcatttacaaatgatttggaattcagttcggaaaatcaaacttcgaccagtttcaaaactcaacctcaaccatcagaagtttcttgcgttgaatcggattcgaattcagatcctttatataatgatcctctgaggcaattgaatgaagaactcaataaaactcgggaagaaattttaactttagctcgagttgcagcaaataatgatggaattgaagagataccaccgcaaatatgtcaatacggttggattaataattataattttttcggtaatacatttgcacaaaatcaaaaagttgaggatcctgttcaacagcctacatttcaatctacaccaaatcatagcgacagtgatggtttaggagatggattactccttggaagtaatcgaagattaaaaagaactcgatcggcaaatataaaaagaaagttttctggaagttcgacaaatgaaaaaaatttattagaacctgaggattcaagttcaactaattccgaggatttttcatgtttaaccgaaaattacataaataaaaatattaaagttaatgcaaatttttcggagaattctttacgaagtaatagaagttctgccaatctcgtggtgaaaaaatttggaagaaggtcgggtttgaaatcctctaccaacagaattgctcctgctgatttaagtccagttggtaatgtttccaaatactctgaaactttgtgtaactcatattgtattacttcttcatcggatgttttgtatcaatggagtataaaaggaataacaaatatgaatacacttttaggattggaaaatgaggattcaatgtaa

SEQ ID NO: 39 - DNA, 3330 bp, Acromyrmex echinatior
atgggtggtgtttgctcgtgccgcgttggtcgcaacagccaggtcaacgccggttcgatcctcgaccgcgtgatcagccaggcaagcaacgaggaccagtgtttattgtatcgattggcgaactacaagaagggcggtgagctaatcgaggcgtacaaccagggcggtcagcctgaggtggagaagctgatccgcgagcaatttggtatcctgatgtatatggatggcaaaggccagataatcaatcgtgccgagtatctacgttggaaatttcgtgacctcgagcaagtcgtgttgccgatcgaggcctcgctgtcgcgttttgatccactagcgcagtggaatgatcatgaagcctgctggcagatgcagtacagaggctcgctgggcgagaccttgttgcatgttcttatcatatgtgacacgcggatgcatactagaatagcgcgcatactgctcaagtgttttccgcggctagctattgacgtcgtcgagggcgaagagtatctgggtgcgagtgctcttcatctggcgatcgcctatgcgaacaacgagctcgtgcaggatctggtcgaggcgggcgcgattatctcgcagcgggccatcggtagcttcttcctgccgcgggatcagcaaaggatgaatcccgccagaaataccgattacgagggtctcgcgtatctgggagagtatcctctcgcctgggccgcctgctgcgctaatgagagcgtctacaacctgctgcttgattccggcgctgatcctgacgagcaggatacttttggaaatatgattttgcacatggtcgtagtttgcgacaaattggacatgttcggctacgcattgcgacatccgaagcttcctgctcgcaatggaattgtgaatgccgcgggcctgaccccgttgacactcgcctgccagctggggcgtgccgaggtcttccgtgagatgttggagctgtccgcgcgggagttttggcgttacagtaatatcacttgctcggcgtaccctctcaatgctctcgacacgctgttgcccgatggcagaacaaactggaactctgcgctatttatcattctgaacggtacgaaggaggagcacttggacatgctggacggtggtattattcagcgattacttgaggaaaaatggaagaccttcgcgcgattgcagttcctgaagcgattgattatcttggtgtttcacctggcctcgctgtccttagccatgtacttcaggcccgcggacatggaggctgtgctgctgcagtggcccgaggagataacggacgtcgtccgcaccgcggcggagtgcatcaccgtgctgggcgtgctgaattacatcctggtgcagctgggatgcgaaatgatcaacgtcggtccgctatcattcctgaagcaactgagccacgaaccggccaagttgatattcgtgatcagcaatctgctcattctcgcgtgcattccatgtcgtatcgctggcgatcggcacgcggaggatgcgatactgatgttcgctgtgccgggctcatggtttcttcttatgtttttcgccggagcgattcgattgactggtccatttgtcacaatggtatacagcatgataacgggcgatatgctgacctttggtattatctacacggttatgctctttggattctcgcaatcattttactttctttataagggattccccggagtgaaatcatctctgtatcattcctatccttcgacctggatggcactgtttcagataaccctcggcgattataactacgcggatttgagtaacacgacctatcctaacttgagcaagaccgtctttgcgattttcatggtacttgtgcccatactgctgctcaacatgctaattgccatgatgggtaatacatatgcacatgttatcgagcaaagcgaaaaggaattcgtcaagcagtgggcaaaaatcgtggtgtctttggaacgcgccgtatctcagaaagatgctcataattacctacaggaatacagcattaaactgggacccggcgatgatccgaacaaccccgcgtcggaacaaaggggcgtgttggttattaaaagtaaatcgaaaaccagagcaaagcagcgtaagggcgctgtgtctaattggaagcgagtcggaaaagtcacgatactcgaattgagaaaacgaggtatgactggcgaggaactccgtcgtataatgtggggtcgcgcgtccttttccacccctgtgcgagtcagtcccaatgccggtcaaccgcaagtgtcggcagttactgcaggttttgatgatgcgttaaccgcagctttggacgtaatggcctttgcacatgactttgacttatccactgcgacggaaggcatacctaccaatatcgacgcaaaacagataaagacagcgcagtcgaaagccgctctcaacgaccagcagacgaaaacaacccaaaataatccagaagtggtgataaatgtgcaaccgcataatcaacccattaaagaggaaactaaattatcaggtctcacagatttaatcgataagtctatcgatcccgtaaaggatgtggaggcaatgaatttgagaaatatgaatcaaacgaaagcgctcgaagaaaccgtcgaagatccatttttggaactcgctatcgcttctgagactacaacggattacaaaactctactgcaaatagcgaagtccgctttagccacaagcgaagcttcaatgaaaaccacaatcgacccgcaaattctagcacacttcgccatggtcgcgccgccgaccattgagaaatcttctatcgttaagaaacagtatttcatggagtccagcgacaatgacctcggcggcgataatttacttggcaccgaagctcgccttcgaaggataaaatccgcgaataacagattcactacatcgaaacggtcacgccgtgatgacgatggcgacagttcctcatctacaacatccgtcgaacaaagtctgcgatatcgaccactactgaatgatccggaacagagaccgatgaatcgtatcgagactgaaggacgaaagaccaccgtggaaacaattaagccggaggtcaaacagaatggcagcattcctaccaaaccactcgataaaatccaaaaacgtcgaccaaaaacggccaagaatagggtatcgcctaaagaaactgaggaaccagcgaggagaagggaatcgattgagcggaataaggcggcttcaccacctacgtcgtcctcggatccgctcgagccatggagcacgcgtggcattaccgacatgaacacaatattggcttggcgggaaaacgcaccggacagtccttaa

SEQ ID NO: 40 - DNA, 3339 bp, Harpegnathos saltator
atgggtggtgtttgctcgtgtcgcggccgcggcagccaggtcaacgccggctcgatcctcgaccgcgtgatcagccaggcgagcaacgaggaccagtgtttgttgtatcggctggccaactacaagaagggcggcgagctgatagaggcttacaaccagggcggccagccggaggtcgagagactgataagagagcaattcggcatcctgatgtacgcggacggcaagggtcaggtgatcaatcgcgccgagtatctacgctggaagtttcgcgacctggagcaggtcgtgctgccgatcgaggcgtcgttgtcgcgcttcgacccgttggcacagtggtacgaccacgaagcctgctggcagatgcagtacagaggctcgctgggagagagcctgctgcacgtgctcatcatatgcgacacgcgtatgcacacgaggatagcgcgcacgttgctcaagtgcttcccacggctggccatcgacgtggtcgagggcgaggaatacctcggcgctagtgcccttcatctggcgatcgcctacaacaacaacgagctcgtgcaggatctggtcgaggcgggcgcgatcatctcgcaacgggctatcggcagcttcttcctgcccagagaccagcagaggatgaatcccgtaaggaacaccgattacgagggactcgcgtatctcggggagtacccgctcgcgtgggccgcgtgctgcgccaacgaaagcgtttacaacctgctgctcgactccggcgccgatcctgacgagcaggattctttcggaaatatgattttgcacatggttgtagtgtgcgacaaattggacatgttcggctatgccctgcgacatcccaagcttcccactcgcaacggaatcgtgaatgccgcaggcctgaccccattgacactcgcctgccagctggggcgtgccgaggtcttccgtgagatgctggagctgtccgcacgggagttctggcgttacagtaatatcacctgctcggcgtatccactcaatgctctcgacacgctgctcccggacggtagaacaaactggaactctgcgctatttatcattctgaacggtacgaaggaggagcacttggacatgctggacggtggtgttattcagcgattacttgaggaaaaatggaagacctttgcgcgattgcagttcctgaagcgattgattatcttggtgtttcacctggcctcgctgtccttagccgtgtacttcaggcccgcggacatggacgccgagttgctgcagtggcccgacgagattacggacgccgcccgcatcgcggcggaatgcagtaccgtgctgggtgtgctaagttacatcctggtgcaactgggcggcgagatgatcaacatcggtccgctgtcgttcctgaagcaactgagccacgaaccggccaagttgatattcgtgatcagcaatctgctcattctcgcgtgcattccatgtcgtatcgccggcaatcggcacgcggaggatgcgatactggtgttcgccgtgccgggctcgtggtttcttctcatgtttttcgccggagctatccgactgaccggtccgttcgtcacgatggtgtacagcatgataaccggcgacatgctgaccttcggcatcatttacacggtcatgctctttggattttctcaatcgttttatttcctctacaagggattcccgggcgtgaagtcgtccctctaccattcctatccttcgacctggatggcgttatttcagataaccttgggcgattataactacgcagacctaagtaacacgacctatcccaacttgagtaagacggtctttgcgatcttcatggtgctcgtgccgatattgctgctcaatatgctgatcgccatgatgggtaatacgtacgcgcacgttatcgagcagagcgagaaggaatttgtgaagcagtgggccaaaattgtggtatctttggaacgcgctgtgtcgcagaaggacgcccataattatctacaggaatacagtatcaagttggggccgggcgacgatccgaataatcccgcatcggagcagagaggtgtgctgattattaaaagcaaatcgaaaactagagcgaaacagcgcaagggcgccgtggctaattggaagcgagtcggaaaagtcacgataaacgagctgagaaaacgaggtatgactggcgaggagctacgccgtataatgtgggatcgtgcgtccatctccactcctgtgcgagtcagtcctaatgtcaacgagccacaagtgtcggcagttactgcaggttttggtgacgcgctaaccgcagctttggacgtaatggcctttgcgcacgactttgacttatccactgcgacggaaggcgtaccgagcaatatcgacacgaggcagacgaaagccatccccgacgagcagacgagaacggctcggaataatccaaaggcggtgacggatgtccaaccgcacaaacaagccatcgggggggaggagaccaagttgtcaggtctcacggatctaattgatatgtccgccgccgaaccggcgcgcgtggaagcgatgaacttgaagaacgcgagtcaagcaaaggcgcacgagggagctgtcgaggatccattcctggagctcgctatcgcctccgagactacggaagattacgatactttattgcaaatggccaagtccgccctagctaccagtgaggcttcaaccacggtcgacccacaaattctagcacacttcactatgatcgccccgccgcccgttgaaaaacccatcgttgttaagaaacaatacttggtggagtccagtgacaacgatctcggtggcgacaatttgctcggtaccgaagctcgcatcaggaggataaagtcggcgaatgatagattcatcagcacatccaaacgatcacaccatgacgacgataacgacagttcctcgtccgtcacttccgtcgaccggagtcagccgcagtatcgaccgctgctgaatgattcggaagagagcctggcgaaccgcgtcgagaacgaaggacgaagaacttccgacgtcgaaacaattaagtcggaagtcaagcagaacggccgcggcggcggcggcggcggtgtttccaagccgtcggataaacgcgtccagaaacgccggccgaaaacggccaagaacagggtatcgcctaaggaaatagaggaaccggcgaggagacgagaagaatcgattgagcggaataaggcggctctttcacctccggcgtcgccctcggatccgctcgagccatggagcacgcgtggcattaccgacatgaacacgatattggcctggcgggagaatgcaccggacagtccttaa

SEQ ID NO: 41 - DNA, 3315 bp, Bombus impatiens
atgggtggtgtctgctcgtgtcgaggtcgcggtagccaggtgaatgctggctcgatccttgatcgagtgatcagtcatgcgagcgacgaggatcaatgtctattgtatcgtctggccaattataagaagggcggcgagctgatcgagtcgtacaatcaaggtggccaagcggaagtggaaaaattgatcagggaacagttcggtgtactgatgtacgcagatgggaagggtcaggcgatcaatcgggcggaatatctacgttggaaattccgtgacctcgagcaggttgtgctaccaatagaggcttctttgtcacagtttgatcctctggctcaatggaacgatcatgaagcatgttggcagatgcaatatagaggatcactcggagagactctcctgcatgtcctgattatatgcgataccaggatacacacacgactagcgcgtattctgcttaagtgctttccacgattggctattgacgtagtcgagggcgaggagtacctcggcgctagcgctctgcatctcgctatcgcgtacaacaataatgaactggttcaagatctcgtggaggcgggagcgattatttctcagagggcgataggcagctttttcctgcctagggaccaacaacgaacgaatccagctaagaatacggattacgagggattagcatacctgggagagtatcccctcgcctgggctgcttgctgtgcaaacgagagtgtttacaacttattactcgactctggcgctgatcccgacgagcaggactcttttgggaacatgatactacatatggtagtcgtttgtgataaattggacatgttcgggtatgccctccgtcatccgaagcttcctgctcgcaatgggatcgtgaatgccgccggactgaccccattgacgctcgcctgccagctgggtcgcgcagaggtctttcgggagatgttggaactgtctgcacgagaattctggcgttacagtaatatcacctgctcggcatatccgctgaatgcactcgacacgctgttacctgacggcagaacaaactggaactccgcgctatttatcattctgaacggtacgaaggaggagcacttggacatgctggacggtggtattattcagcgattactcgaggaaaaatggaagacctttgcgcggttgcagttcttgaaacggttgatcatcctggtgttccatctgacatcactctcgctagccgtgtatatgagaccgtcaaacatcgatgccaccctcctggaatggccggaagaaatcacggaagttggacgcatgatcgcggagtgcaccacggtaataggtgtgctgagctacattttggtgcaactaggcggcgaggtagtcaacattggtcttctatcgttcatgaaacaattgagtcacgagcctgccaagctcatattcttgatcagcaatctgctcatactcgcgtgcataccatgtcgtcttgctggtaataggcatgctgaagacgcgatactcgtggttgctgttcccggctcttggttcctcctcatgttctttgctggcgctatccggttgaccggtccattcgttaccatggtctacagtatgataaccggtgacatgttgaccttcgggataatctacatggtggtgctgttcggattttgccagtcgttctactttttgtacaaaggcttcccgggagtgaaatcatccctctacagttcctatcactcgacctggatggcactgtttcagataaccctcggcgattataactatacggacctcggctacacaacctaccctaatttatcgaagatggtgttcgccatatttatggtcctggtgcccatactgctgttgaatatgctgattgcgatgatgggcaacacttacgcgcatgtgatcgagcagagcgagaaggaatgggtgaagcaatgggcgaaaatcgtggtttctctggagcgtgcagtcgcgcagaaagatgcgcagaattatttgcaagaatacagtattaaactgggacctggagatgacccgaacaaccccgcctcggaacagcgcggagtcctgattattaaaagtaaatcgaaaaccaaggcgaagcaacgcaaaggcgcggtggctaattggaagcgcgtaggcaaagtgacgataaacgaattgaagaaacgtggtataacaggagaggcgttgcgacgagtcatgtggggccgagcatctttctccactcctgttagaacgagtccaaacactgccgagcctcaagtttcagcggttacggccggttttggagacgcattgactgcagcgctggatgtgatggcgttcgcccacgatctcgacttgtctactgctacggaaggaattccgaccaacatcggcgcgaagcagtcgaaatcgaagaccgcctgcaaggatcaagcgaaatcggcgacgaataatcaggagaaagggtcgacggacgttcagcaacaacggaaactaaccacggaaaatctggataatctggcgagcagtcataatgatattgacaaaacatccagcgaatttgtggccgttcgcgagatgaattcgaagaacgcgagtcattcgagcatggccgaggattttcaggatccgcttttggagcttgtgattgcttccgaaaatacggacgatcctgaaacgctgctgaaaatagcggagcgggccgcagcgaatttcgaagtggagagcagttcgaaaataaatctgcaaattttggagcaattcacgatgactaagctacctatggaggagaaagttgccgctacaaagaagcagtactttgttgaatcgagtgacaacgattttggtggcgacaacctactcggaaccgaggcccgtctacgtagaataagatcagcgaacaacagatttatcacgacacggagacggtcgcggcacaccgatgacgacctgtcatctacgtcgtccacatccgccgacagaaatcctcaatatcagccattgctcaacggccctgagaacttggcgagccgtcaaatcgaaagtcgagagagctctatcgaagcaattaagccgcaagtaaagcagaacgggtcatgcgattcagtgaagatcaaggttcagaagcgtcgaccgaaaacggcgaaaaatagggtatcaccgaaggaaatagaggaggctggtccgaggagaagagaatcgatcgagcggaataaggcggtttcgccggcgacgtcgcctactgatccgctcgaaccatggagcacacgcggcattaaggacatgaacacgatattggcttgggaggagaatacgccggacagtccttaa

SEQ ID NO: 42 - DNA, 3075 bp, Bombus terrestris
atgggtggtgtctgctcgtgtcgaggtcgcggtagccaggtgaatgctggctcgatccttgatcgagtgatcagtcatgcaagcgacgaggatcaatgtctattgtatcgtctggccaattacaagaagggtggcgagctgatcgagtcgtacaatcaaggtggccaagcggaagtggaaaaattgatcagggaacagttcggtgtactgatgtacgcagatgggaagggtcaggcgatcaatcgggcggaatatctacgttggaaattccgtgacctcgagcaggttgtgctgccaatagaggcttctttgtcacagttcgatcctctagctcaatggaacgatcatgaagcatgttggcagatgcaatatagaggatcactcggagagactctcctgcatgtcctgattatatgcgataccaggatacacacacgactagcgcgtattctgcttaagtgctttccacgattggctattgacgtagtcgagggcgaggagtacctcggcgctagcgctctgcatctcgctatcgcgtacaacaataatgaactggttcaagatctcgtggaggcgggcgcgattatttctcagagggcgataggcagctttttcctgcctagggaccaacaacgaacgaatccagctaagaatacggattacgagggattagcatacctgggagagtatcccctcgcctgggctgcttgctgtgcaaacgagagtgtttacaacttattactcgactctggcgctgatcccgacgagcaggactcttttgggaacatgatactacatatggtagtcgtttgtgataaattggacatgttcgggtatgccctccgtcatccgaagcttcctgctcgcaatgggatcgtgaatgccgccggactgaccccattgacgctcgcctgccagctgggtcgcgcagaggtctttcgggagatgttggaactgtctgcacgagaattctggcgttacagtaatatcacctgctcggcatatccgctgaatgcactcgacacgctgttacctgacggcagaacaaactggaactccgcgctatttatcattctgaacggtacgaaggaggagcacttggacatgctggacggtggtattattcagcgattactcgaggaaaaatggaagacctttgcgcggttgcagttcttgaaacggttgatcatcctggtgttccatctgacatcactctcgctagccgtgtatatgagaccgtcgaacatcgatgccactctcctggaatggccagaagaaatcacggaggttggacgcatgattgcggagtgcaccacggtgataggtgtgctgagctacattttggtgcaactaggcggcgaggtcgtcaacattggtcttctatcgttcatgaaacaattgagtcacgagcctgccaagctcatattcttgatcagcaatctgctcatactcgcgtgcataccatgtcgtcttgctggtaataggcatgctgaagacgcgatactcgtggttgctgttcccggctcttggttcctcctcatgttctttgctggcgctatccggttgaccggtccattcgttaccatggtctacagtatgataaccggtgacatgttgacctttgggataatctacatggtggtgctgttcggattttgccagtcgttctactttttgtacaaaggcttcccgggagtgaaatcatccctctacagttcctatcattcgacctggatggcactgtttcagataaccctcggcgattataactatacggaccttggttacacgacctaccctaatttatcgaagatggtgttcgccatatttatggtcctggtgcccatactgcttttgaatatgctgattgcgatgatgggcaacacttacgcgcatgtgatcgagcagagcgagaaggaatgggtgaagcaatgggcgaaaatcgtggtttctctggagcgtgcagtcgcgcaaaaagatgcgcagaattatttgcaagaatacagtattaaactggggcctggagatgacccgaacaaccccgcctcggaacagcgcggagtcctggttattaaaagtaaatcgaaaaccaaggcgaagcaacgcaaaggcgcggtggctaattggaagcgcgtaggcaaagtgacgataaacgaattgaagaaacgtggcataacaggagaggcgttgcgacgagtcatgtggggtcgagcatctttctccactcctcgagacactttgagagctctcggatctgtaggtattgtgagagctgtaggaactctcggacctgtaggtactgtgagagctgtaggagctctcggacctgtaggcactgtgagagattcgagcatggccgaggattttcaggatccgcttttggagcttgtgattgcttccgaaaatacggacgatcctgaaacgctgttgaaaatagcggagcgggccgcggcgaatttcgaagtggagagcagttcgaaaataaatctgcaaattttggagcaattcacgatgactaagctacctatggaggagaaagttgccgctacaaagaagcagtactttgttgaatcgagtgacaacgattttggtggcgacaacctactcggaaccgaggcccgtctacgtagaataagatcagcgaacaacagatttatcacgacacggagacggtcgcggcacaccgacgacgacctgtcatccacgtcgtccacatccgccgatagaaatcctcaatatcagccattgcttaacggccctgagaacttggtgagccgtcaaatcgaaagtcgggagagctctatcgaagcaattaagccgcaagtaaagcagaacggatcatgcgattcagtgaagatcaaggttcagaagcgtcgaccgaaaacggcgaaaaatagggtatcaccgaaggaaatagaggaggctggtccgaggagaagagaatcgatcgagcggaataaggcggtttcaccggcgacgtcgcctactgatccgctcgaaccatggagcacacgcggcattaaggacatgaacacgatattggcttgggaggagaatacgccggacagtccttaa

SEQ ID NO: 43 - DNA, 2898 bp, Dendroctonus ponderosae
atgggtgggtgccaatgtaagccatgctgcagacacaagaaatcgcactacactggaggctcaattttggatcgagtaattagccaaagctccaatcaagaccagtgtttgttataccgattggccaactacaagaagggaggggaattaattgatgcctacaatgcaggcgggcagattgagtgcgagaagctgatccgcgaccaattcgcgcaactgatgtatcaggatggcaaagggaagattatcaaccgatctgagtatctaagatggaaattcagggatcatgagcatgtgattcttccaatcgaagcgtcactaagtcgttacgacccattaggcaaatggaccgaccatgaagcctgctggcaaatgcagtacagaggctctctaggcgaatccctgctccatctgctcattatttgcgacagcaaaatccacaccagactggcaagaacgttaattaaatgcttcccgaaactggcgcttgatgttgtcgagggagaagagtacttaggggctagtgctcttcacctagctatagcctacagcaacaacgaactagtgcaggacctagttgaggctggagctaacgtgaaccaacgagctatcggtaagcaaatcgctgataaaaccggcaaaattaacgcaaaaaaccgtttttttctgccgagagatcagcaaaaacagcgaccagctaagcatacagactacgaaggtttggcttatttgggcgagtatccactggcttgggcggcgtgttgtgccaacgaaagcgtctacaatctgcttctggacagcggcgctcatccagatttgcaggacaatttcggcaacatgatccttcatatggtggtcgtttgcgataaattggatatgtttggctacgcgcttcgacatcccaaactgccggctagtaatgggattattaacaaagctggattgactccactcactttggcctgcaaactaggtcgtgcggaagtgttcagggagatgttggaactgtcctgcaaagagttttggagatacagcaacattacatgttcggcgtatactctgaacgctttggacactttgctgcctgatggtcgcaccaattggaactctgccctgttcattatcctcaatggcaccaaggaggcgcatctcgatatgttggatggaggcatcattcaaagactgctggaggaaaaatggaaagcctttgctcggaaccagttcctcaaacgcttaattatcctgatagttcatctagcttttatgtcactggctgtgtatatgaggcctgatgatccggacgaaccgttactggaatggtccgacgatcctacagttatcattcggtatcgtcggcttttccaagagaatccagaggttttactggggttttgtagatttactgctgaaattgggacgctactaaatgtgctcagttacgttgttgtacagcagggagacgaaataaggaaccaaggatttctctcttttttgaaacaacaaacaaattccccgccaaagtgcattttcttagtgtccaacttgatgattctggcatgcatcccttgtagactggccggaaaccgagggttggaagaaacaattttgatctttgctgtgcccggatcctggtttttgctcatgttttttgccggtgctgttcgcttaaccggaccattcgtcacaatgatctacagcatgatcaccggggacatgttaacttttggaataatctacacaattttccttttcggtttttcccagtcgcttttcttcttgtacaagggaaatcccagcgttaatggcacgttgtatcacagctacagctccacttggatggcactgtttcaagtcacaatgggaaattacgattactctgaactggcgctaacaacatatccaggtgtggccaagtccgtattcggtcttttcatggtattcgtcccaatattgctcttcaacatgttgattgccatgatgggaaacacttacgctcatgttaccgaacagagtgaaaaggaatgggtaaaacaatgggcgaaaatcgtaatttccttggaaagggccatcccacaaaaggaggctcataattacctacaggaatatagcatatccttgggaccagctgaagatccagcaaccgaacaacgaggagtgatggtgataaaatcgaaaaacaaaactagagccaaacaacgaaagggagcagtcagcaattggaagagagtgggaaaagttacaataaaagcgctaaagaaaaaagggatgactggggaagagatgcgctgcctaatgtgggggcgagagtcaattaacacgccggtaaaagtaaaagggcctaaaagagaccctttggcaaacccccaaggcccagacttggccaatggcttcggggatgctctaacttctgctctggatgtaatggcgtttacccacgatttggacattaatgctcaaggcctaaatttagcaaaacaaactctaaatcctaagccttttacggaccctctaagaactctggttttggagtctctagtggagaccaattcagccagattgagcgttttggctgcacaagcagccaatttgcctgatactgccgagatcgtctcatgcccaaatacggccaccacttccgtgaagaacctcgcaggaatttttgcagggactggcaattttgtgaagaaaattgaggagaaagtgaagaagaaaaaatatgccgttttggaatgcagcgatagcgagagcttcggaggcaagtgccagggcatttcaacgcatttccagtcaaagactttgaaatattgcagaagtgctgctggggacaatatcacgggtgaagagggccagactgatacatatgcgacattctgcaaacaggaaaaggaatttagataa

SEQ ID NO: 44 - DNA, 3444 bp, Nasonia vitripennis
  modified_base (1051)..(1053): a, c, t, g, unknown or other
atgggtggggcatgctcctgtcagggtcgagacagccaggtcaatgctggctcgatcctcgatcgcgtgatcagccaggcgagcgacgaggaccaatgtctgctctaccggctggccaactacaagaagggcggcgagctgatcgaggcctacaaccagggcggtcaagccgaggtcgagcgtctgatccgcgagcagttcggcatcctcatgtacgccgacggcaagggtcagacgatcaaccgggcagagtacctccgctggaagttccgggacctggaccaggtcatcctgccgatcgaggcgtccctctcgcgcttcgatcccttggcccagtggtcggatcacgaggcctgctggcagatgcagtaccgcggctcgctgggagagacgctgctccacgtgctcattatctgcgacacccgcacccacacccggatcgcgaggacgctgctcaagtgcttccccagactggccatagacgtggtcgagggagaggagtacctcggcgcgagcgcgctgcacctggccatagcctacgctaacaacgagctggtccaggatctcgtcgaggccggggccatagtgtcgcagcgggccataggaagcttcttcctgccgagggaccagcagaggccccgaccggctaagagcaccgactacgagggactggcctatctcggcgagtacccgctcgcctgggcggcctgctgcgccaacgagagcgtctacaacctgctcctcgactcgggagcccaccccgacgagcaggacaccttcggcaacagcatcctccacatggtcgtcgtctgcgacaagctggtcagattcggctacgctctgcgtcacccgaagctaccagcgagcaacggcatagctaacgcagccggcctgaccccgctgacactcgcctgccagctgggacgtgccgaagtcttccgcgagatgctcgagctctccgcccgggagttctggcgatacagtaatatcacttgctcggcgtatccgctcaacgcactcgacacgctgctgcccgacggaaggacgagtnnnaactcggccctgttcatcattctcaacggtacgaaggaggagcacctggacatgctggacggcggcatcatacagcggctgctggaagagaagtggaagaccttcgctcggctgcagttcttgaagcggctcgtaatcctcgtctttcacctggtgtcgctgtcgctggccgtttactttcggcccgcggacactgacgccgagttggcccagtggcccgaggagatcaccgacgtcgtcagagtcatcgccgagtgcgtcaccgtcctcggcgtcttgggttacattctactccagctcggaggggagatcgtcaacatcggcttcttctcctttttcaaacagctgagccacgaacctgccaagttcatatttctcatcagcaacctcctgattctggcctgcatcccgtgcagactgtccggcgaccgacacaccgaggacgccattctcgtggtcgccgttccgggctcctggtttctcctgatgtttttcgccggggcagtacgtctgaccggacccttcgtcacgatggtctatagcatgatactcggcgacatgcggacttttggcatcatctacatgatcgtcatctgcggcttcacccaggcgttctacttcctctacaagggctacccgggagtgaagacgaccctcttccattcctacccctcgacgtggatggcgctatttcagataactctcggcgattacagctactcggacctcagcatgacgacctaccccaatctcagcaaagcggtcttcaccatcttcatggtcctcgtgccgatcctcctgctcaatatgctgatagccatgatgggaaacacgtacgcgcacgtgatcgagcagagcgagaaagaatggatgaaacagtgggcgaaaatcgtggtttcgctggaacgagctgtgtcgcaggacgacgcgcacaattacctccaggagtacagcataaaattgggcccaggagacgacccgaacgatccagcctcggagcaacggggcgtcatggtcataaagagcaaatcgaagactcgggctcgtcagcggaaaggcgccgttgctaattggaagagagtcggaaaggtaacgatcgccgagctgaaaaagcgtggcatgaccggggaggagcttcgtcgcatcatgtggggccgagcgtccttttccacgccggtcaggtccagcccgatcctgatggagccggtgtcatcagtgccaggcggtttcggcgacgccctgacgtcagccctcgacgttatgactttcgccgccgatgtgccggtgcccattgagggtagtatacccaagccagtcgccgtcgccccgggccaacagccgactacaacacttgcactacccaatggagctgcgaaacctcaacagccgatgatgacaacgtcgacgacaacgacgacgatcacgacgacagtgcagaagactctcgttaccggcactgctacaacaccggcggtgggcgttacgaagaccgtcgcggttccagcggcgaccaccgtcagcaccacaacgactcgagcatcagcatcagcagtgccccccacagttcggccgtcagagctcggtccagcctcggccccttgcagcgccgacccactgctggagttgatgctcgcgacggaggatccaggctcgtcggaggagactctgcagcgtctggcgcactcggcccggatcgtgggcgagagcgccaccaccagcgccaagtccgatatcgattcgagcttcctcgagaggcttgcgctcggaggtctcggactcgccgcgatgcccgaacagcctgacaagcccgtcgagcccaagaagaagcagtatctcgtcgagtccagcgataacgatatctgtgcgaacgacggtcagctgggaacggaggctcgactgcggcgcatcaggtcggccagtagccggctagccccgacgacgacgacgtcgacgtcgcgacggaagtccggccagcagaagcagcaacgcgaagccagggacgacgagagcacctcgtccgccgcttcgctcgacaacatttccggctaccagccgctcctgaacgagccggacaccaccgcggaccagcctgccacgggaacagaggacaataagccggccaacggcaggaacctacgcaagagacccaagaccacgagtaacgaaggcaaggtcttctgtagtagaaggacaattgttgtacttaataaaaataagaagaataaaaagctcgagacatctgaagccaacatgaacgccaggaaaaaggaaactcttcttgcactgcacgacatgacaagtttgatctcaggccgtgtactcaccctggaacaggccaatgaaaatggctatgaaatgctggagcagttgaagcataagttggacccataa

SEQ ID NO: 45 - DNA, 3330 bp, Camponotus floridanus
atgggtggtgtttgctcgtgtcgcgttggtcgaggtaaccagcttaacgcaggctcaattctcgatcgcgtcatcagccaggcaagcaacgaggatcagtgcttgttgtatcggctggccaattacaaaaagggcggcgagctgatcgaggcgtacaatcaaggtggccagccagaagtggagaaattggtgcgcgagcaattcggcattctgatgtacgccgatggtaagggccaggtgatcaatcgcgccgagtatctgcgttggaagtttcgtgacctcgagcaggtcgtgctgccgatcgaggcatcgctgtcgcgcttcgatccactcgcccaatggaacgatcacgaggcctgctggcagatgcaatacagaggctcgctgggcgaggctctgcttcatgtcctcatcatatgcgacacgcggatacacaccagaatagcgcgtatattactcaagtgcttcccgcgactcgctatcgacgtcgtcgagggcgaagagtatctcggagcgagcgcccttcacctggcgatcgcttataacaacaacgaactcgtgcaggatctggtcgatgcgggcgcgattatctcgcagcgggccatcggtagcttttttctaccgcgtgatcagcagggaatgaatcccgttagaaacaccgattacgaaggactcgcgtatttaggcgagtacccgctcgcctgggccgcttgctgcgctaatgaaagcgtctacaatctgctgcttgattccggtgcggatcctgacgagcaggattctttcggaaatatgattttgcatatggtcgtagttggcgataaattggatatgttcggctatgctctgcgacatccgaagcttcccgctcgcaacggaatcgcgaatgctgcgggtctgaccccgttgacactcgcctgccaacttgggcgtgccgaggtcttccgtgagatgctggaactgtccgcgcgggagttctggcgttacagtaatatcacctgctcggcgtatcccctcaatgccctcgacacgctactaccagacggcagaacaaactggaactctgcgctatttatcattctgaacggtacgaaggaggagcacttggacatgctggacggtggtattattcagcgattacttgaggaaaaatggaagaccttcgcgcgattgcagttcctgaagcgattgattatcttggtgtttcacctggcctcgctgtccttagcggtatacttcagacccgcggatacggatgccgtgctgctgcagtggcccgaggagataacggacgtcatccgtaccgcggcggagtgcatcaccgtgctgggcgtgctcaattacatcctggtacaactgggtggcgagatgatcaacgtcggaccgctgtcgtttctgaagcaactgagccacgagccagccaagttgatattcgtgatcagcaatctactcattctcgcgtgcattccatgtcgtatcgccggaaatcggcacgcggaggatgcgatattggtgttcgccgtcccgggctcctggtttcttctcatgtttttcgccggagcaattcgattgaccggtccattcgtcacgatggtatacagcatgataaccggtgatatgctgactttcggtataatctatacaatcatgctcttcggattttcgcagtcgttttattttctctacaagggattcccaggcgtgaaatcatctctttatcattcttatgtttcgacctggatggcattgtttcagataaccctcggcgattataactatgcggaattgaataacacgatctatcccaacttgagcaaaaccgtcttcgcgatttttatggtgcttgtgcccattctgctacttaacatgttgattgccatgatgggtaatacgtacgcacatgttatcgagcaaagcgagaaagaattcgttaagcagtgggcaaaaatagtggtgtctctggaacgtgccgtatcgcaaaaagacgctcataattatctgcaagaatacagcatcaagctaggacccggcgacgatccaaacaatcctgcttcggagcaaagaggcgtgctcgttattaaaagtaaatcgaaaaccaaagcgaagcagcgtaagggcgccgtagctaattggaagcgagtcggaaaagttacgataaacgaactgagaaaacgagggatgactggggaggagcttcgacatataatgtggggtcgtgagtccttctctactcctgtacgagtcagtcccaatgctggccaaccgcaagtgtcggcagttactgcaggttttggtgatgcactaaccgcagctttggacgtaatggcctttgcacatgactttgacttatccgcggcgacagaaggcatacccaccaatatcgatgcgaaacaaacaaaaacgacacaatcgaaagccattcccaacgatcagatgaaaacgacccagaataatccagaaacagtgacgaatgtccaaccacataaacagcctattggggagccaactaaattgttaggtcttacggatttaatcgataattccattggtcccgtgaaggatgtggaagcgatgaatttaaaaaatacgaaccaaacaaaagcgctcgaagcatctatggagttcgaagatccatttttggaactagccatcgcttctgagactacgacaaattacgaaatcttactacaaatagcgaagtctgctctagctgccagtgaagcttcggtgaaaactgcaattgatccacaaattctcgcacattttgctatgattcctccgccgatcactgagaaattcatcgttaagaagcaatactttatggaatctagtgataacgatgtcggtggggataatttattaggcactgaagctcgtcttcgaaggataaaatctgcgaataacaggttcataactacatcaaaacggccacatcgtgatgatgatggcgacagttcttcgtccactatatcaattgaacgaaatcaacgatatcgaccattattcaacgatccggaagaaagatcgataaatcatgtcgaaactgaaggtcaaaaaactcccatggaaacaattaaatcggaaatccagcagaatggtagcattccactcaagccacccgataaaattcaaaagcgtcgaccgaaaacagccaagaacagagtatcacctaaggaaatagaggagccgaggagaagggaatcgattgagcagaataaggcggcctcaccaccgacgtcgtcctcggatccgctcgagccatggagcacgcgtggcattaccgacatgaacacaatattggcttggagggataacgcaccggatagtccttaa

SEQ ID NO: 46 - DNA, 2974 bp, Danaus plexippus
atgggtgtaccgttaagtaagctgtgttcagcaacgagtgtcccagccgttggctcggttctcgaccgtgtcatatcccagcccagcagcgaagatcacactgtcttatataagctcgctgattataaagaggtttactattagaaacctatactaagggcggcgtggtagccgccgagcgcctcatcagagaggagttctcggcatatatgtacgctggtggacggggccgggtcatcaacagagctgaatacctccgatggaagtttcgagaccaggaagttgttctcccaatagaagcgtctctctcacctcacgatcctctagcgaaatgggaagatcacacagcttgctggcagatgagttaccgcggagcactgggggagtcacttcttcatgttctcattatatgcgacatccacacaagattggcgagaactttggtcaaatgttttccgaaattgtccctggatgtcgtcgaaggtgaagaatgtgctagttcgttacatttggccatcgcctatagtaataatgaattagtccaagacttggtcgaagctggcgcggatgttagtcagaaagctgtagtttctttctcccgagagaccaacaaaaaaatccaccagctcgtcagacaaattacgaaggtttggcgtatttaggggagtacccactagcgtgggctgcttgttgcgctaacgaggccgtatataacctccttctggactctggagctgatccagacgcccaggattcatttggaaatatgatcctgcatatggttgtagtttgtgataagttggatatgttcggctatgcccttcgtcatccaaaggtaccagccagtaacggcagactaaataaggctgggttcacaccgctcacccttgcctgccaattggggcgagcctcggtgttcagggaaatgttggagctttcatccagggaattttggagatattccaacatcacctgttctgcatatccattgaatgctctagacactttgctacctgatggacgtacaaattggaattccgcattattcatcatacttaatggcactaaacaagagcatcttaatatgttggacgggggaatcatacaaaggctcttagaagagaaatggaaaacatttgccagaacaaaatttttaaagcgtctattaatcctcatgctacatctgatcttgctatccatatctgtgtatctacgtcacagcagtctggaagcggatgtagaccccgactggggtttagaggtcaatgatgcaaggtccgggataagattggcctgcgaactaggaactatcataagcactctttgctatattattctgcagcaaggcgatgagatcaaaaaccaaggtgttgttgcgtacttcaagcaactaatccatgaaccagccaaatttatattcctagcttcaaacatattgttactggcgtgtattccagcaagaataagccaaagaactactttggaagaagcaatactaatattcgtactacccggttcttggttccttatgatgttttttgcaggagccgtgaagttgactggcccgtttgttacaatgatatacagcatgatcactggggacatgttcacattcggcattatctactgcatagtattgttcggattctcgcaatctttttacttcctgtataaagggtttccgaacgtacattcaactctgtactccagctatcccagcacctggatggctctttttcaaatcacgttaggcgactacagttacacagatctcggtctgacgatgtatcctaatttgtcgaagacagtgttcactgttttcatggtgttcgtccccattctgctactcaacatgctgatagccatgatgggtaacacatacgcacacgttatagagcaatcagagaaggaatgggtaaaacagtgggcgaagattgttgtgtctctggagcgttcagtatcccaggaagatgctcatcgttaccttcaggagtattcaataggtctgggaccctcagacgaccctcgttatgagcaacgaggtgttatggtaattaagagcaaggccaaaactcgcgccaagcaaagaaagggcgcgctgtctaattggaagcgtgtgggtaaagttactatagcagagctgcggcgccgcggcattagtggagaagaattgagaagactcatgtgggggagagtctcaatatctactccaaccaaagcacccttaaaatgtgtgcctcccccggagttagtgacttcagaaattccaggaagtggagttggaccagcgttgtcatcagctcttaacgtgatggcgtacacacaagatctagacctcaccaacaccggatcagaactgcataaacagataacgcccgatttgctcgtcaatggcaagacgcctgtgacagcacagaatacagcaaccactcccaaagtaccacttgtaaatctaccaaataaagcgggattggacgttcaaagtacgggaagtgatcagagcgtgccaactgcattaactaagaatatggacgttttgggcataaatatgtcaacacaggatttgctaaagaatcaaactataaacaatcccgctacagccaacgaaatagtgttcaaagattatctcagggatatcataaaggcggagcaacttggtctagataatattgacataaaggccctcgcagagaaagcggccaacctcaccgacgtaccagagatagacattaacatatctacggctgcaaggtctgcccgtcgtgtggtagccggcgctgtttctggtctgttcggtgtgacagcagagactccgcgggacgcaggctggcgcagagagagacacgaacatacagacagtgaccctgtcccagagtgcgtcatactgggtcgtgcggcgcgcgctcgccgtgcacgatctgcttcccggcgcgcgccccctcccccacctcacctctacgttcctgcgaggtaa

SEQ ID NO: 47 - DNA, 3540 bp, Bombyx mori
atgggtaatgccattggaaaatttctaactgcgggcaacgttcaaggtgctggctcggttctcgatagagtcatatcccagccgagcagcgaagaccacaccgtactttacaaattagctgattataagaaaggcggtctacttttagagacctacgcgaaaggtggcatgacagccgctgaaaagttaatgagagacgaattcgctgcatacatgtacggcggagggaggggccgggtcatcaatcgtgctgaatacttgagatggaagttcagagaccaagaacaggttgtacttccaattgaagcatcgctctcaccttatgacccgctcgccaaatgggaagatcacaccgcctgttggcagatgtgttatagaggagctctcggcgaatcattgcttcatgtactcattatttgtgatactaagattcatacaagattagctcgaactctagtaaaatgttttccgaagctgtcactagatgtcgttgaaggtgaagaatatttaggggcaagctctttacatctggcaatagcgtacagcaataacgaactagtacaagatctagttgaggccggagctgatgtcaaccagagagccattggtagctttttcctaccccgcgaccaacaaagagttccgccagcgcgacaaacaaattacgaaggtctggcatacttgggcgaataccccctagcctggacggcttgttgcgcgaacgaagcagtctacaacctcttactagattccggggcagatcccgatgctcaggattcgttcgggaacatgatactacacatggtggtcgtttgtgataaactggacatgtttggatatgccctgcgtcaccctaaagttccggccagtaacggtcgaatgaataaagcaggtttcaccccactaaccttggcttgtcagttgggtcgggcctctgtcttcagagagatgctggagctatcagccagagagttctggcgctactccaacattacgtgctccgcttaccctttgaacgctttagataccttgctgcctgatgggcgaacaaattggaattcggctttattcattatactgaacggaacaaagcaagaacacttgaacatgttagacggcggtatcatacaaaggttgcttgaagaaaaatggaagactttcgccaggacgaaattcctcaaacgtctcctcatactgatgctgcatcttctcctgctctccgtttctgtgtacctacgtcacagcagcgcagaagctgatgcccaccccaactggggcttggagatcaacgacgctagaagcggactgagacttgccagtgaacttgggactatattgagcacattgtgttatattatactgcaacaaggcgacgagctaaagaatcaaggattggtcgcttattttaagcagttgattcacgagccggccaaatttatatttttggcgtcaaacatccttgtgttagcgtgcataccggccagactccttaaggagaccaacgtggaggaagccatactgcttttcctgctgccgggatcgtggtttttgttgatgttttttgctggcgcggtgaaattgaccggtccattcgtgacaatgatctacagtatgataacaggggacatgttcacgttcggtatcatctactgtattgtcctcttcggcttctcgcagtcattctacttcttgtatagaggttttccaaacgtacagtcgactttgtactcgagctaccccagcacgtggatggcactattccaaatcaccttaggagattacagctactcggatctcagtcagacaacataccctaatctctcgaagactgtgttcacggtgttcatgatattcgtgccaattctactattgaacatgttgatcgccatgatggggaacacgtacgcccacgtcattgagcaatccgagaaggaatgggtcaaacagtgggcgaaaattgtggtatcactagagcgttcagtggcccaggatgacgcacataagtacttgcaggagtattctataggacttgggccttccgacgatccgagatacgagcaacgagcggtcatggtcatcaagagcaaagctaaaactagagcgaaacagaagaaagacgctttaactaattggaagcacgtcggtaaagtgacaatagcagagttgagaagacgcggtatcagcggtgaagagttacgtagattgatgtggggccgtatttcaatttcgacaccaacaaaagctcccttgccgcgaagagtcccagccccgcctccagactgcgtggtttcgtcagacgtgggtttagctagtgacgtagggaacggtgtagcaccagctctctcgtcagctctcaacgtcatggccttcactcacgaattagacattggcactactggttctgatcaaaaacaaactacaccggacttgttggtcaacggcaaaacttccaatgccccaatcttaactaccggtacccaaatgccaaaagtttcaagcaaaactctcggtacaccagtggcacgtattgaagcatcttcacttaagacgcctttggatgttaaattaaacccaacaacattgacacagtccacggttcagggtaatataggtaatgtcaatattcctataagtggagtgaaaataacaacaaatgttggacaaaactccgcggtagtacctgagattcaacagtcgaatgaaaatcagaaacctgagcaagtacaccaagattatctgcgtgaactcatagttcttgctgagaaacctgcaaccactaatcttgaactcaaacaacttgctgagaaagcggctgatctgagagatgtaccggaaattgatattaacatcaatatggctgcaaaatctgcgcgtaaaatggtagcgggtgctgtgtcgggtttattcggtgtcgccgctgacactcctgcccccgatgctggctggaggcgggatcgtcatgacaacagcgacagtgatccgatatcggagtcagtgctgttaagtcgagcatcaagagcaagacgcgcgaggtcagcatcgcgacgagccgcaccaccgcccccacatctatatgtaccggctaggtctatgtacttagtggcatctgagagcagtgctatagaaagtgatgcaccttgggatgatcaacccagttcagagaacaattcagctgtaggtggtcgtagagaagagatcgcccacattaaagctgcaagacccttgtgtattcaacatgctgcgtcagggagaacggctcaagtagaacactcattatttgttgtaggtcctggaaccggagccgaagttgaaagtactcctactgtacaaaaatccgaaaaaaaggctagacctaaaacaacgcgatctagacgaaacagaatatctccaacaccggtacaagaagcgggcagccctttggagccctgggccacagcacaactatcgaagctatcacgtctcatacgctattccagctcatcagcagcttctatcacctcgcagacgtccacggaacaggagcaatcgccaagatactga

SEQ ID NO: 48 - DNA, 2982 bp, Acyrthosiphon pisum
atgggaaattcttgtgcgagttgcacagatttctcattctcgaaaacagcttcaggatctgttctggatagagtgatttctcaagcgtcaaatgaagacgattgtttgttgtataagttagcggattataaaaaaggaggagaattgatcaatgtgtataataatggtggtcaggacgaagcggaacgatttattgttgaaaaattacccggccttatgtataacaacggtaaaggtcaagtgataaatcgaaatgattatttgagatggaaatttcaaaatcgtaaacacgtggctgttaatgtcgaggaaaggccgggtcctcacgatccgttaacaagatgggtggaccatgtggcgtgctggcaaatgcagtatagaggatcattaggcgaaagtttgttgcacgtattaatcatatgcgataccgtgatacacactcggctgtcccgactacttctcaaacactacccgatgttaagtcaagatgttgtggaaggcgaagaatatctcggcgctagtgcattacatttgtctattgcttataacaacaacgatttaatccaagacctggttgatgctggtgctaatatttgtcaaagagccatagggagctttttcttaccacgcgatcaacagaataaagaaatcaataacaaacacacggattacgagggtctagcgtatctcggggagctgccattagcgtgggctgcttgttgcgggaaccaaacggtatacaacctgttgattgatgctggagcaaaccctgacgcccaggactcatttggaaatatgattctccatatggtggtcgtttgtgataaactgagtatgtttggttatgctttgaaacaccctaaagtgaaagcaagtaacggtatcatgaacgtggcaggactaacacctttaacactatcgtgcaaacttgcaagaactagtgttttccgtgaaatgttggaactaagtgcacgggaattttggagatatagtaatattacgtgttcggcataccctttaagcgcgttagacacgttacttccagacggaagaacaaattggaattcagtattgtttataattttggacggtaccaaagaagaacatttggacatgctcgatggaggcattattcaaaaattattagaagaaaagtggaaaacttttgctcggaaacaatttatgaaacgtttagttatattatccatccatctaatcatgttgagtatttctatatacctaagacccgtggaccaagacaaaccactgttaggagaagcagaagactggcaagacgtggcaaggtattgttttgaaggcggaacagtagtcggagtgctgtcatatttaattgttcagcaaggtggagaaatactcaatcaaggtctggtaggatttttaaaacaaacgttcaaagaaccggccaaactgatatttctgatttcaaatttattgatattggcttgtataccacccaggatgatgggcgacaaacagacggaggaagccatattagtatttgcagttcccggatcatggtttttgttaatgttttttgctggcgctatacgcctgactgggcctttcgtaactatggtgtacttgatgatcacaggagacatgttgacctttttcgtcatctactcagtaattttgtctggttttacgcaatcgttttttttcctctacaaaggatcgccagacgtcagtacgtcgttatataaatcttacccttctacgtggatggccttatttcaaattactatgggcgactacaattacgcggatttgagttacaccgtatatccagcgctcagcaaaactgtgtttacggttttcatggtgttggtgccaattttattacttaacatgttaatagctatgatgggcaacacttatgcgcacgtcatcgaacagagcgaaaaggaatggatgaaacagtgggccaagattgtagttacccttgaaagagctgtaccacaaaaagcagccaggaattacctcgaagaatatagtattcagttggctcccggcgacgatgtaaatccagaacaaagaggattcatggttatcaaatgtaaaagccaaactagagcgaaacagcgaaaaggcgccgtcataaattggaagaaaagtggaaagttggtcattcaagagcttcgtagattagaaggtactggccagaatctaagagatatgatttggaaacgatcgtctctatcagcgtcttctccggttgctaaaagtgtatcaataacaaaaaataaaagcaagtcctattctgaagcaaaagatgaccaaattcggctttctggtgcactaggagcagcactagacgcgattgcagtagctcatgacttagacatgactctgacaaaagatcaatcgattgatgaattacacgaccctttaagacaattagtaataatgtcagaaagtgataaaaatattgataaaagtcaagtcgaaatagtggcgaatgcagcagcaaaaattgcaaatcaagattctataaaaccgatatcgattaatttagagcaacaaaatgacgtaaaaaatgaaaaaaccaaaattccaacttccagtaacacaataacaaatagaaaactcttaaacaagcaatctaaaaatttaagcatgtatggttttgagagtcaggacatgtcagtagataaatacagcaaagcaattgcaatcacaagaagtatatcaactcaaactggaggtattggtatcatcgaaaaaaacgaacgacagataattcgaccgaaaactgcaaaaatcaatcgcgtgacgcccacgcagaatttcgcagtgaaaagaggccaatcggcacagccggacaaacgggaagaccacagggataacaaggagcaacagtgttattgcatcagtggcaacaacatgttgcggccgtggagcacgcaagacctggcgccgttgaacacgatcatggcgtggggtcccaacgacgatttctga

SEQ ID NO: 49 - DNA, 825 bp, Solenopsis invicta
caatttatcgccaactacgaccatgtgtaaaatcatatttccgaaagaatcctgctcgtcaggatccgcgccggaatcaagcagcagattgtagacgctctcgttagcgcagcaggctgcccaggcgagcgggtactctcccagataggcgagaccctcgtaatcggtatttctggcgggattcatcctttgctgatcgcgcggtaggaagaagctaccgatggcgcgctgcgagataatcgcgcccgcctcaaccagatcctgcacgagctcgttgttgttgtaggcgatcgccaggtgaagggcgctcgcaccgagatactcctcgccctcgacgacgtcgatagacagccgcggaaagcacttgagcagtatgcgcgctatcctcgtgtgcatccgcgtgtcgcatatgatcagtacgtgcaacaaggtctcgcccagcgagcccctgtactgcatctgccagcaggcctcgtggtcattccactgcgccagaggatcgaagcgcgtcagcgaggcctcgatcggcagcacgacttgctccaggtcgcggaacttccaacgtaaatactcggcgcgattgattgtctggcccttaccgtccgcatacatcaggataccgaattgctcgcgaattagcttctccacctccggttgaccgccctgattgtacgcctcgatcagctcgccgcccttcttgtagttggccagccgatacaataaacattgatcctcgttgctcgcctggctgatcacgcggtcgaggattgaaccgggattgacctggctgccgcgaccaaagcggcacgagcacgcaccacccat

SEQ ID NO: 50 - DNA, 426 bp, Schistocerca americana
caccacaattttggcccaytgtttcatccactccttctcgctctgctcgatracgtgcgcgtacgtgtttcccatcatggcgatcagcatrttgagcagcaggatgggcaccagcaccatgaaaatggcgaacactgtcttggccagcgttggatatgtcgtgtggctcagttctggrtagttatagtcgcccatggtgatctggaagagcgccatccaggtggtggggtaggagtggtagagcgacgtcttcacgccggggaagcccttgtacagaaagtagaaggactgagagaagccgaacagcacaaccgtgtagatgatgccgaacgtcaacatgtcaccggtgatcatcgagtacaccatcgtcacgaacggaccagtcagccggrtggcccccgcgaaaaacatcagcaggaaccagga

SEQ ID NO: 51 - DNA, 2670 bp, Myzus persicae
  modified_base (865)..(886): a, c, t, g, unknown or other
  modified_base (1112)..(1306): a, c, t, g, unknown or other
  modified_base (2234)..(2277): a, c, t, g, unknown or other
gaaaggccgggccctcacgatccgttgacaagatgggtggaccacgtggcgtgctggcaaatgcaatacagaggatcattaggcgaaagtctgttgcacgtattaatcatatgcgatactgtgatacacactcggctctcccgactacttctcaaacactaccctatgttaagtcaagatgttgtggaaggtgaagaatatctcggcgccagtgcattacatttgtctattgcttacaacaacaacgatttaatccaagacttggttgatgctggagcaaatatttgtcaaagagccatagggagctttttcttaccacgcgatcaacagaataaagaaatcaataacaaacacacggattacgagggtctagcgtatctcggagagctaccgttagcgtgggctgcttgttgcggaaaccaaacggtatataacctgttgattgatgctggagcaaaccctgacgcccaggactcgtttggaaatatgattctccatatggtggtcgtttgtgacaaactgagtatgtttggttatgctttgaagcaccctaaagtgccggcaagtaatggtataatgaacgtggcaggactaacacctttaactctatcgtgtaaacttgcaagaactagtgttttccgtgaaatgttggaactaagtgcaagggaattttggagatatagtaatattacatgttcggcgtatcctttaagtgctttagacacattacttccagacggaagaacaaattggaattcagtattgtttataattttggatggtacaaaagaagaacatttagacatgctcgatggaggcataattcaaaaattattagaagaaaagtggaaaacttttgctcggnnnnnnnnnnnnnnnnnnnnnnttatattatccatccatttaatcatgttgagtatttctatatacctaagacccgtggaccaggacaaaccattgttaggagaagcagaagactggcaagacgtggcaaggtattgttttgaaggcggaacagtagtcggagtgctgtcatatttaatcgttcagcaaggtggagaaatactcaatcaaggtctggtaggatttttaaaacaaacgttcaaagaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacatgttaacctttttcgtcatctactcagtaattttgtctggttttacgcaatcgtttttttttctctacaaaggatcgccagacgtcagtacgtcgttatataaatcttacccttctacatggatggccttatttcaaattactatgggtgactacaattacgcggatttgagttacaccgtataccccgctctcagcaaaactgtgtttacggttttcatggtgttggtgcccattttattacttaacatgttaatagctatgatgggaaacacttatgcgcacgtcatcgaacagagcgaaaaagaatggatgaaacagtgggctaagattgtagttactctcgagagagctgtaccacaaaaagcagccaggaattacctcgaagaatatagcattcagctggcacccggtgacgacgtaaatccagaacaaagaggattcatggtaattaaatgtaaaagtcaaacacgagcgaaacagcgaaaaggcgcagtcataaattggaagaaaagtggaaagttggtcattcaagagcttcgtagattagaaggcactggccaaaatttaagagatatgatttggaaacgatcgtctctatcagcgtcttctccggtcgctaaaagtgtatcaataacaaaaaataaaagcaagtcttattctgaagcaaaagatgaccaaattcggctctctggtgcactaggagcagcactagacgcgattgctgtagctcatgatttagacatgaccctgacaaaagatcaatcgattgatgaattacatgatcctttaagacagttagtaataatgtcggaaagtgataaaaatattgataaaagccaagtcgaaatagtggcgaatgcagcagcaaaaattgcaaaccaagattctataaaaccgatatcggttaatttagagcaacnnnnnnnnnnnnnnnnnnnnnnnnnnnnnnnnnnnnnnnnnnnnacaattacaaatagaaaactgttaaacaagcaatctaaaaatttaagcatgtatggttttgagagtcaggacatttcagtagataaatacagcaaagaaattgtaatcacaagaagtatttcaactcaaactggaggtattggtatcatcgaaaaaaacgaacgaccgataataagaccaaaaactgcaaaaatcaatcgcgtgacgcccacacagaatttcgcggtgaaaagaggccaatcagcacagccggacaaacgggaagaccacagggataacaaggagcaacagtgttattgcatcagtggcaacaacatgttgaggccgtggagcactcaagacctggcaccgttaaacacgatcatggcttggggtcccaacgacgatttctga

SEQ ID NO: 52 - DNA, 2904 bp, Bemisia tabaci
atgtacaatgatggcaaaggacagatcatcaaaagagcagagtatttacgttggaagttcagagatcagcaacaggtaactctacctattgaagcatctctgagtcctcatgatcccctcgccaaatgggaggaccatgaagcttgctggcaaatgcagtacagaggctccttgggtgaaaccttattacacgtcttgataatctgtgacacaaaaaccaacactcgcctggcccgcacattgcttaagtgcttccctcgattggctcaagatattgtagaaggagaagagtatcttggtgccagtgctcttcaccttgctattgcatacaataataacgaattagtccaggatttggtagaagcaggagcaaatgtcaatcaaagagcaataggtagctttttcctgcccaaagatcagcaaagaccgagacctgctaaacacacagattacgaaggtttggcttacctcggagaatttcctctttcgtgggcagcctgttgcgccaatgaatcagtttacaatctacttctagattcaggagcccatccagacatgcaggacacttttgggaatatgattctgcacatggttgtcgtttgtgacaagttggacatgtttggttatgctttgagacatccaaaactgccagccagtaatggtattaccaacacagctggcctcacgcctctcacattagcctgcaagttgggccgtgcagaagtttttcgtgaaatgttagaactgagcgcaagggaattttggaggtacagcaacataacatgctcagcgtaccctttaaatgctctggataccctgttacctgacggacgaactaactggaattctgctctgttcatcattcttaatggtaccaaagaagaacatctagacatgttagatggtggaatcattcaacgattactggaggagaagtggaaaacgtttgcaagacgccagtttttaaagcggctggcaattttgtttctccaccttctcatgctaagtatggccgtatacctgagaccagtggacagggagcagcctcttataggaggagatgactggtcggatattgcgcgatacggttttgaagttggcactatcatgggcgttttatcgtatctagttgtacaacaaggtggggagattaagaatcaaggtcttggaagtttcttgaagcaattgatggcagaaccagccaaagcaatattccttgtttcaaatcttctaattctggcttgcatcccttttcggatggcaggggactcgcaaacagaagaggctattttaattttagccgttcctgggtcatggtttctactaatgttttttgctggggctgtgcggctgactggtccctttgttacaatgatctacagtatgattactggtgatatgtttacgttcggaattatctactcaattcttttgtttgggttctctcagtcattctatttcttgtacaaaggctcgccaaatgtgaagcaaactttatttcactcttatccaacaacttggatggctctcttccaaattactttgggtgactataattatccagagttggctttcaccgtgtatccaactctgagcaagatagttttcactagtttcatggttctggtgccgatcttgctgctgaacatgttgatcgctatgatgggtaacacctacgctcatgtcatagaacgcagtgaaaaggaatggatgaagcaatgggcgaaaattgttgttgctctggagcgagctgttcccgcagcagatgcgcataactatttgcaagagtacagcataaaactagggcctggcgatgatccatcaacggaacaaagaggtgtcatggtaatcaaaagtaagagcaaaacacgtgccaagcaaagaaaaggagctgtatccaactggaagcgagttggtaaagtcaccatcaatgaattacggaagcgaggaatgacaggtgaacagctgaatcgaatcatgtggggacgagcttccatatcgacaccagttcgacagcctgccatggctctattacttgaagatagtgaagaagaaaatgctgcaaacaatactggtccatttggtggagcgctgacagctgccttggacgtaatggccttcacccacgacatagacttaaatattggtcaaacgccggtcacagtttctggccttggtggtgtttccgttcgcagtggagctgaaggtcttcctccagaacaaccattccatgacccattccggcagctggtgattgaagcagaaaatcctcatattgatgaatccgaattagcagctcttgcaaatgctgctgcaatgtccgttgttgcgcctgatgatattccgactcctgtggttacacctgagcctgtatctgcattacctcgattgccctctcttcatctagaaccaagtgacagtgatggacttggagatggacctcttcttggaagaggtagtcgtgtgcgcagagttcgttctgcacatctgaagcagcaaaaagcatcttctacgaatgggaatggctattcagacagacaaagacttttttcatctaagaatgaagactcaagttcaaatacttcattagatttcgacctgacaaatcctccttctcaattgaggctcactccacctcctagaccggtaacagctgaaattgtggctgtaaatccgaagaaatacataggtggaaacagtcaagagaggttaaggccaaaaacagctaaagtcaacagggttgcgccaacccccgatgttcctgtgcgtcgagggatttctgctaatggtatcccagaatcactgccgtctccacctgatccactagagccatggagcactcgtaatatcgtcaatatgaatgcaattcttgcatggcagcaaagtgatcaggatagtttgtaa

SEQ ID NO: 53 - DNA, 2955 bp, Euschistus heros
atgggcatcatctggggcagtggtgcttcttcagtgaatgctgggacagtacttgaccgagtgatctcccaagcatcaaataaggatgaatgccttctttacaaattggccaactacaagaagggaggagagctgatagatgcctataatgcaggaggccaaagtgaggttgagaaactgataagggaacagttcggccaattgatgtataatgaaggaaagggtgctctcatcaacagagctgaatatctgcgatggaaatttagggacatgcaacaggtacagatccctatagaggcatctttatccagccaagatccattgtcaaaatgggaggatcaccaagcttgctggcagatgcagtatcgaggttcactgggagaaacattgctgcatgtacttataatttgtgatacaaagatacatacgagactagcaaggacactattaaagtgtttccctaatcttgccatagacgttgtggaaggagaagaatayttaggtgctagtgccctccatttggctattgcatatttcaacaatgaattagttcaagatcttgttgaagctggagcgaatgtagaacaaagggcaataggcagtttcttccttccaagggaccagcaagggcagagaccatcaaagcacacagattatgagggcttagcctacctcggggagtayccattggcctgggcagcctgctgtgctaatgagagtatatacaatttacttctggacaatggagctaatcctgatcacagggacacattcggaaacatgattcttcatatggttgtggtctgtgacaaacttgatatgtttggatatgctctcaggcatcccaagatgcctgcttcaaatgggatagctaatgtcgcaggcttaacacctcttactcttgcctgcaaactagggcgtgcgaaggtctttcgagaaatgttggaattgagtgccagagaattctggagatacagcaatattacatgctctgcttatccattgaatgcgcttgatacactgctccctgatggcagaacaaactggaattcagctctcttcataattctaaatggaacaaaagaagagcacttagatatgttagacggaggtataattcaaaggttgctagaagaaaaatggaaarcatttgcaaggaggcagtttttaaaacggctagtaatcctaatgcttcatttactctgcctgagcggagcagtttatcttcgcccaacagacagaactaaaccactcttaggaggagatgattggaaatcagtagcgaggcaaggttttgaagtagcaactgttttaggtgttctttcgtatgttatagtacagcaaggaggagaaataaggaaccagggatttatatctttcatcaaacaactggacycagctaaagccatcttccttgtatcaaatatcttgatattaatatgtatcccatttcgattgatggatgacaaaagaactgaggaggcaatattagtatttgcagtgcctggatcatggttcttactcatgttttttgcaggtgcagtgagattaacgggaccatttgtaacaatggtatatagtatgatagttggagacatgtttacttttggtataatttattctattgtgctctttggattttcccaatcattctattttctgtacaaaggatttccaggagttaaaaatactctttacagctcataccacagcacatggatggctttatttcagatcactctcggtgattataattatgctgaattgtcgcatacttcatacccgacattaagtaagacagtgtttgctatcttcatgattctagtccctatacttctgcttaacatgttaatagctatgatgggaaatacttatgcccatgtgattgaacaaagcgagaaagaatggatgaaacagtgggccaaaattgtggtttcactggaaaragcggtaaaccaggaagattgcaaacaatatttacaagaatacagcataaagctaggacctggagatgacccatcgacagaacagcgtggagtaatggttataaaaagtaaaagtaaaaccagagctaaacaaaggaaaggagctgtagctaattggaagagagtgggcaaggtaacaatcaatgagcttagaaaacgagggatgaacggagaacaattaagaagaataatgtgggatagagcttcaatatcaacaccagttaaagtacctcaaaaccctgtagtagatgtattaatggaaaacacggcagaacaacaagcccaacaaactccaggaagttttggaggagcattaactgcagcacttgatgtaatggctttcacacatgatttagatttatcagcatctggaatcacttcttccggcttaaatgcaaaagaacttattgttagcgatcccttccgtgatctggtgttgagctccgaaatagatgtgggagaggaagaattggcaacacttgcggaagctgctgttctatcggtgatgtcaggccaatctgatgaatcagaaaaactaaaaatagctaaatttaataagcaaatcagttttgaacagaatgcagttcttgaagtgagtgacagcgatggattcctagatggccagccattgggtcaaggatcacgagcaagaaaagttaaatcagctcaagagaggcaaagagcagagaggacgtggggtggaacaagcatatcgtcaatagaggaaccaccaccatacctccctttacctcccccaccaccactgcattcccatcaacgaccaaggcccaaaactgcgaaacctaacagagtcgtcccagaagcagtggtagcaaagcgtccacagagctcagctttaggggacagggttaagtccccaccagaactccttgaaccatggagcacaagaggcattgcaaccataaatacaatacttgcttggcaaccttctgatcaagatagcatgtag

SEQ ID NO: 54 - protein, 833 aa, Drosophila melanogaster
MGNTESNVTSGVKKQAGVSTQALYKFVNLKGGGLLVDMMKRACQTKQFAEIDHAIKTKVEPFLYNKGAGRYFPISKLVLLRNRDRPRTRQLPEIRALENPDDDFNIHDYCPEVSEAEYISNPTAYRFVCWDLNMRGAVGETILHLCLLNASSLHADLAKRLLKFYPKLILDIYMSDEYYGESVLHIAIVNEDPAMVKYLLDANADVQERCCGAFMSAEDTKFSRTDSPDHEYVALCPMTNYDGYVYWGEYPLSFAACLSQEECFRLVLARGADPDFQDTNGNTVLHMLVIYEKIEMFDVGYEVGTNIHIKNIQNLTPLTLAAKLGRVEMFFHVMSIEREIYWQLGSITCAAYPLLMIDTINEETGNINKDSVLNFVVFGDKLEHLELLDGVVIDLLKTKWDTFCKSRFYKQFYMFALYFLISLFSFILRPGPDAKDEDEDGANSTTAKSDLYRQNGSDSYHLHSKRATMTTEYKTFWLNFTEYYDPSEVEVLPAWWESYAQCPLMNLESDLAKLRIMAELLNFVGAILYLLVALREARFLGLKMFIENLMTAPSRVMFLFSCALMMTIPWLRVSCLTEIDDHVTVVIMLTTAPYFLFFCRGFKTVGPFVVMIYRMVMGDLLRFVSIYLVFVMGFSQAFYIIFLTFDNPSSPEDQDAESNPMPSPMESIVAMFLMSLTNFGDYYGAMVSTQHEYEAKILFFLFMVIVSVLLVNMLIAMMGNTYQKIAEIRNEWQRQWARIVLVVERSVPPAERLKNFMQYSQSMSDGRRALVLRLNMTEEKEEMKEVQEMKRIHQRFAKKRQMEREARALRRQQEYEKFFGTAPKSECSDNNNF

SEQ ID NO: 55 - protein, 834 aa, Drosophila melanogaster
MGNTESNVTSGVKKQAGVSTQALYKFVNLKGGGLLVDMMKRACQTKQFAEIDHAIKTKVEPFLYNKGAGRYFPISKLVLLRNRDRPRTRQLPEIRALENPDDDFNIHDYCPEVSEAEYISNPTAYRFVCWDLNMRGAVGETILHLCLLNASSLHADLAKRLLKFYPKLILDIYMSDEYYGESVLHIAIVNEDPAMVKYLLDANADVQERCCGAFMSAEDTKFSRTDSPDHEYVALCPMTNYDGYVYWGEYPLSFAACLSQEECFRLVLARGADPDFQDTNGNTVLHMLVIYEKIEMFDVGYEVGTNIHIKNIQNLTPLTLAAKLGRVEMFFHVMSIEREIYWQLGSITCAAYPLLMIDTINEETGNINKDSVLNFVVFGDKLEHLELLDGVVIDLLKTKWDTFCKSRFYKQFYMFALYFLISLFSFILRPGPDAKDEDEDGANSTTAKSDLYRQNGSDSYHLHSKRATMTTEYKTFWLNFTEYYDPSEVEVLPAWWESYAQCPLMNLESDLAKLRIMAELLNFVGAILYLLVALREARFLGLKMFIENLMTAPSRVMFLFSCALMMTIPWLRVSCLTEIDDHVTVVIMLTTAPYFLFFCRGFKTVGPFVVMIYRMVMGDLLRFVSIYLVFVMGFSQAFYIIFLTFDNPSSPEDQDAESNPMPSPMESIVAMFLMSLTNFGDYYGAMVSTQHEYEAKILFFLFMVIVSVLLVNMLIAMMGNTYQKIAEIRNEWQRQWARIVLVVERSVPPAERLKNFMQYSQSMSDGRRALVLRLNMTEEEKEEMKEVQEMKRIHQRFAKKRQMEREARALRRQQEYEKFFGTAPKSECSDNNNF

SEQ ID NO: 56 - protein, 838 aa, Musca domestica
MGNTESNVTSGVKKQAGVSTQALYKFVNLKGGGLLVDMMKRACQTKQFAEIDHAIKTKVEPFLYNKGAGRYFPISKMVLLRNKERARTKQLPEIRALENPDEDFNIHDYCSEVSEAEYISNPSAYRFVCWNLNERGAVGETILHLCLLNASSLHADLAKRLLKFYPKLIMDIYLSDEYYGESVLHIAIVNEDPAMVKYLLDANADVQERCCGAFMSAEDQKASRYDSPEHEYVGVHPMTNYDGYVYWGEYPLSFAACLSQEECFRLVLARGADPDSQDTNGNTVLHMLVIYEKIDMFDVAYEVGTNIHIRNVQNLTPLTLAAKLARVEMFFHILSIEREIYWQLGSITCAAYPLSKIDTIDVKTGNINKDSVLNFVVFGDKLEHLELLDGVVIDLLKTKWETFVKSRFYKQFYMFSFYFLFSLVSFISRPGPKIEDEDEEGDANDSAGKGNDSTTNARLLYATPASRVTGIEKLPYKTFWLNFSEYIDDDANAENMPSWWASYEECPLMDMETNLAKFRIVSEIVIFFGAILYLLSALREAKFLGYKMFVENLMTAPSRVMFLFSCCLMMTIPWLRLSCLTELDDHVAVMIMLTTAPYFLFFCRGFKTVGPFVVMIYRMVMGDLIRFVSIYLVFVMGFSQAYYIIFLTFDNPATPEEIDDTGTNPMPSPMESVVAMFLMSLTNFGDYYGAMGSTQHEYEAKILFFLFMVIVSVLLVNMLIAMMGNTYQKIAEIRNEWQRQWARIVLVVERSVPPAERLKNFMQYSQPMSDGRRALVLRLNMSDEDKEEMKEVQEMKRIHQRFSKKRQMEREARAKKRQEEYEKFFGATPTSDNENNNF

SEQ ID NO: 57 - protein, 844 aa, Ceratitis capitata
MGNTESNVTSGVKKQAGVSTQALYKFVNLKGGGLLVDMMKRACQTKQFAEIDHAIKTKVEPFLYNKGAGRYFPISKLVLLRNKERARTKQLPEIRAMENPDEDFNIHDHCTEVSEAEYISNPSAYRYVCWNLNERGAVGETILHLCLLNASSLHADLAKRLLKFYPKLILDVYMCDEYYGESVLHIAIVNEDPAMVKYLLDAGADVQERCCGAFMSAEDQKASRYDSPDHEYVGVQPMTNYDGYVYWGEYPMSFAACLSQEDCFRLVLARGADPNLQDTNGNTSLHMLVIYEKIEMFDVAYEVGTNIHLRNVQNLTALTLAAKLGRVEMFFHILSIEREIYWQLGSITCAAYPLSMIDTIDVETGNINKDSVLNFVVFGDKLEHLELLDGVVIDLLKTKWESFVKSRFYKQFYMFSFYFLFSLISFISRPGPTEKNEDDDDDDDADASVEATVTRAANSTAPLQRGDQWFKRLIKRAIDKMEYKTFWLNFTDYFDDNDVESVPPWWASYAECPLMNMESDLAKLRIVAEIIIFFGSVLYLFAALREARFLGYKMFVENMMTAPSRVMFLFSCALMMSIPWLRVFCLTEIDDHVAVFIMLTTAPYFLFFCRGFKTVGPFVVMIYRMVMGDLIRFVSIYLVFVMGFSQAYYIIFLTFDNPATPEEIDDSESNPMPSPMESIVAMFLMSLTNFGDYFGGMASTQHEYEAKTLFFLFMVIVSVLLVNMLIAMMGNTYQKIAEIRNEWQRQWARIVLVVERSVPPAERLKNFMHYSQPMSDGRRALVLRLNMSDEVKEEMKEVQETKRIHQRFSKKRQIEREARAQKRQEEYEKFFGKKPSGNSDNNNA

SEQ ID NO: 58 - protein, 833 aa, Anopheles gambiae
MGNTESNVTSGVKKQAGVSTQALYKFVNLKGGGLLVDMMKRAIQNKQYAEIDHAIKTKVEPFLYNKGKGKYIPVSVLVLLRNRERPRHKQLPEIRAMENPEEDFDIDAVCPEVSEAEYYLNPSGYREVCWNIKERGAVGETILHLCLLNATSLHADLAKRLLRFYPKLINDVYMCDEYYGENVLHLAIVNEDPAMVKYLLDHNADVNERCCGTFMCPEDQKASRYDTPETEVVQMVQVTNYDGYVYWGEYPLTFAACLGQEECYRLVLARGADPDNKDFNGNTVLHMLVIYEKIATFDMGYEVGSSLSIRNHQNLTPLTLAAKLGRVEMFFHIMNIEREIYWQLGSITCAAYPLGLIDTIDVETGNINKDSALNLVAFGDKDEHLDLLDGVLIDLLKTKWNTFVKDKFYRQFFMFFCYFCVSLVSFTLRNGPPPAEDDDGKESEAGGNKTAAVTKEELRRQLWNETTLEDALAALAGNGSFAGRLSNLEQSNGSSDAMGEFDPAEMDDEGLFFNSNCHTMDYDGVEGKVRLISEMIILVGSFLYLLAALRELKFLGRKMFFENLMTAPSRVMFLFSCCIMMIVPFLKVLCFTELEDHVAVTIMLTTAPYFLFFCRGFKTVGPFVVMIYRMVMGDLLRFVVIYLVFVMGFSQAYYIVFLSYKPDEEGDPNPMPSPIESIVAMFLMSLTNFGDYYGALENTDHEMCAKILFVLFMVIVAVLLVNMLIAMMGNTYQKIAETKNEWQRQWARIVLVVERGVPPKERLKNLMSYSQPMSDGRRALVLRLNMTEDKEEMKEILEMKRVHERLSIKRQIERDARAEQRRLLREKYLNMSS

SEQ ID NO: 59 - protein, 815 aa, Aedes aegypti
MGNTESNVTSGVKKQAGVSTQALYKFVNLKGGGLLVDMMKRAIQNKQYAEIDHAIKTKVEPFLYNKGKGKYIPVAQLVLLRNRERPRSKQLPEIRALENPEEDFDIDAVCPDVTEGEYQRNPSGYREVCWNIKERGAVGETILHLCLLNATSLHADLAKRLLRFYPKLINDIYMCDEYYGESVLHVAIVNEDPAMVKYLLDSGSDVDERCCGTFMCPEDQKATRYDSIETEIICVLPMTNYDGYVYWGEYPLSFAACLGQEECYRLVLARGADPDNQDSNGNTVLHMLVIYEKISTFDMAYEVGSSLDIRNLQNLTPLTLAAKLGRVEMFFHIMNIEREIYWQLGAITCAAYPLALIDTIDIETGNINKDSALNLVVFGDKAEHLDLLEGVLIDLLKTKWNSFVKDKFYRQFFVFFWYFCVSLVSFTLRRGPMNLEETAANRTTTSITLKNLTFSDSTNATLPTLLAADVNEKIVQFIANETLFDPAVMEENTFFNSKCATMAYDTLQDKIRLVSEIIILIGSFLYLVGALREFRFLGRKMFFENLMISPSRVMFLFSCCIMMIVPFLKVLCLIELEDHVAVTIMLTTAPYFLFFCRGFKTVGPFVVMIYRMVMGDLLRFVVIYLVFVMGFSQAYYIVFLSFKGEEEGDENPMPSPMESIVAMFLMSLTNFGDYYGALEKTEHEGCAKVLFVIFMVIVAVLLVNLLIAMMGNTYTMIAETKNEWQRQWARIVLVVERGVPPSERLKNFMSYSQPMSDGRRALVLRLHMTDEDKEEMKEILEMKRVHERLKKKRQVERELRAEQRRLIMEKYANVP

SEQ ID NO: 60 - protein, 816 aa, Culex quinquefasciatus
MGNTESNVTSGVKKQAGVSTQALYKFVNLKGGGLLVDMMKRAIQNKQYAEIDHAIKTKVEPFLYNKGKGKYIPVAQLVYLRNRERPRHKQLPEIRALENPEEDYDIDKECPDVTEGEYMRNPGGYREVCWNIKERGAVGETILHLCLLNATSLHADLAKRLLRFYPKLINDVYMCDEYYGESVLHLAIVNEDPAMVKYLLDAGSDVNERCCGTFMCPEDQKASRFDSLETEIICVMPQTNYDGYVYWGEYPLSFAACLGQEECYRLVLARGADPDNQDSNMNNVLHMMVIYEKLTTFDMAYEVGSSLSIRNLQNLTPLTLAAKLGRVEMFFHIMNIEREIYWQLGSITCAAYPLALLDTIDIETGNISKDSALNLVVFGDKDEHLDLLEGVLIDLLKTKWNTFVKDKFYSQFFVFFCYFCVSLISFTLREGPMKLEDGEANKTTTSIQLKNMTLADLTNASTLSSLLVTDVSGKIVGLNGSETFFDPSTIESDMFFNSKCPTMIYKGIEGKIRLVSEAIILVGSFLYLVSALRESRFLGRKMFIENLMTAPSRVMFLFSCCIMMVVPCLKVLCFTELEDHVAVVIMLTTAPYFLFFCRGFKTVGPFVVMIYRMVMGDLLRFVAIYSVFVMGFSQAYYIAFLSYKGEEEGDENPMPSPMESIVAMFLMSLTNFGDYYAALEDTAHEGCAKVLFVTYMVIVAVLLVNLLIAMMGNTYTKIAETKNEWQRQWARIVLVVERGVPPAERLKNLMNYSQPMSDGRRALVLRLNMTEEDKEEMKEILDMKRVHERLSKKRAVEREARAEQRRLIAEKYANVP

SEQ ID NO: 61 - protein, 794 aa, Tribolium castaneum
MGNTESNVTSGVKKQAGASVQPIYKLCDLKGGGLLVELMKRATQNKQYAELDHAIKTKVEHFLYNKGAGRYFTISDLVLLRNKERSRQKWLPQLKAMENPEDFEIDDEGPEITEEQYQKNPHLYRHVCWKIKERGAVGESIMHLCLLNATSLHADIAKRLLRFYPKLINDIYMSDEYYGENVLHIAIVNEDPSMVKFLLDSGVNIQERCCGNFMCPEDQKSSRYDSLDHEWVNVCPVTNYEGYVYWGEYPLTFAACLGQEESFRLMLSRGADPDAQDTNGNTVLHLLVILQKLEAFDMAYEVGAKLSIRNVLSLTPLTLAAKLARIDMFFHILNLEREIYWQIGSITCAAYPLSQIDTIDIETGQISKTSALNLVVFGDKDEHLELMDGVLIDLLNAKWNTFVKFKFYKQFFTFAFYFLISLVAFTLRPGPPHKEAKLVNVTINATVSNTSKWENLTSIPFGKTPDDDDSDMEEWWDNLQEECRLMQLESPESKIRLTAEVLMVVGAFAYLAAAVREARFLGGRMFFENLMTAPSRVMFLFSCILMLTVPCLRLACLDEFEDIVAVVIMLTTAPYFLFFCRGFKTVGPFVVMIYRMVMGDLIRFASIYLVFVMGFSQAFYIIFLSFDNPLTPDDVDDSATNPISTPIESIMAMFLMSMTNFGDYYAAFEKTDHEYEAKMLFVVFMVIVSILLINMLIAMMGNTYQKIAETRNEWQRQWARIVLVVERGVSPSERLKQLMVYSQPMSDGRRALVLRLNQSDEDKEEMKEILEMRRRHERHIKKRSEKLKENAKKN

SEQ ID NO: 62 - protein, 841 aa, Bombyx mori
MGNTESNVTSGVKKQAGTSEQKLYKLVDIKGGGLLVDMMKRALQNKQYAEIDHAIKTKVEPFLYNRGRGRYIPISHLVLLRNKERPRHKLLPPLRGMENPDEEFDVDKDWPVVTQEEYDANPSGYRELCWDVKERGAVGETILHLCLLNATSLLAHLAKRLLRFYPKMINDIYISDEYYGETVLHITIVNEDPTMAKFLLDAGADYHERCYGNFMCPEDQKASRTDSFDHEWVNVQPDTNYNGYVYWGEYPLSFAACLGQEECYRLILARGADPDKQDTNGNTVLHMLVIYEKMSTFDMAYEVGASLNIRNVQNLTPLTLAAKLARTEMFFHILNIEREIYWQIGATTCAAYPLGQVDTIDTETGLISKDSALNLVVFGEKDEHLGLLEGMLIDLLKTKWNTFVKFRFYRQFILFSCYFLVSLICFTLRPGPPDRALNTTVLNSTIGPNVTDAELVSDVENCTMTPNADFDTNAVEVLNGTKFGGSHCARFKSHPKEKSTEAPRENDVEGWWEDLTEECRLMNLDTWQAKLRISAELLLWMGALAYFGAALREAKFLGIKMFIENLSTVPSRVMFLFSCLLMLILPTLRLWCADEAEDHLAVMIMLTTAPYFLFFCRGFKTVGPFVVMIYRMVMGDLLRFVCIYLVFVMGFSQAYYVIFLSFDNPNTPEGVDDSVSNPMPSPMESIMAMFLMSLTSFSDYYTAFDRTDHEIEAKLLFVIYMIIVAILLVNMLIAMMGNTYQKIAETRNEWQRQWARIVLVVERGVPPAQRLKQLMTYSQPMANGKRALVLRINQKDEDKEEMKEILEMKRTHERIVAKRKQREALKPGEIPPPARDYPIRK

SEQ ID NO: 63 - protein, 792 aa, Anopheles darlingi
MGNTESNVTSGVKKQAGVSTQALYKFVNLKGGGLLVDMMKRAIQNKQYAEIDHAIKTKVEPFLYNKGKGKYIPVSVLVLLRNSERPRHKQLPEIRALENPEEDFDIDAVCPEVSEAEYYLNPSGYREVCWNVKERGAVGETILHLCLLNATSLHADLAKRLLRFYPKLINDVYMCDEYYGESVLHLAIVNEDPAMVKYLLDHNSDVNERCCGTFMCPEDQKASRYDTPETEVVQMVQLTNYDGYVYWGEYPLTFAACLGQEECYRLVLARGADPDNKDFNGNTVLHMLVIYEKITTFDMGYEVGSSLSIRNHQNLTPLTLAAKLGRVEMFFHIMNIEREIYWQLGSITCAAYPLVLIDTIDVETGNISKDSALNLVVFGDKDEHLDLLDGVLIDLLKTKWNTFVKDKFYRQFFMFFCYFCVSLIGFTLRNGPPPPEEDDENRAGGGSGNKTSSASKQDLRQRLWNRTVTLEDADNVSSLLSDIMGIDALGKLAEQLLNGSEGSGAFKPETVEEEEDGLFFNSKCHTMDYDGVEGKVRFVAEVIILIGSFLYLLSALRELKFLGRKMFFENLVSRGFKTVGPFVVMIYRMVMGDLLRFVVIYLVFVMGFSQAYYIVFLSYKPEEDGDANPMPSPIESIVAMFLMSLTNFGDYYGALENTDHEMCAKILFVLFMVIVAVLLVNMLIAMMGNTYQKIAETKNEWQRQWARIVLVVERGVPPKERLKNLMSYSQPMSDGRRALVLRLNMTDEDKEEMKEILEMKRVHERLSKKRQVERDARAEQRRLLREKYLNMT

SEQ ID NO: 64 - protein, 900 aa, Acyrthosiphon pisum
MGNTESNVASGVKKQVDTSSLQIYNLVDLKGCGLLVDLMKKAVQTKNFTELDNAIKTQVEPMLYNKGEGRMIPIAKLVLLRNRDRSRARWLPPLKNMEDTNDYDIEKDIPTIEELEKLGEVQYREVCWDLKERGTVGETALHLCLLNATSIHADLAKRLLHFYPKLVNDIYMIDEYYGESVLHMAIVNEDPAMVKVLMDSGANLNERCFGNFMSTEDQKASRSDSLDHEWVNLCPDTNYEGYVYWGEYPLSFAACLGQEESYRLMLARGADPNNQDTNGNTVLHMLVIYEKISTFDMAYEIGAELNIRNVQNLTPLTLAAKLARIQMFFHILKIEREIYWQIGSITCAAYPLTQIDTIDNDTGQISRNSALNLVVFGESPEHLEMMDGVLVDLLNAKWNAFVKFRFYRQFILFAFYFSISMVCFVLRPGPPPTGLKPPLINYTSTSTTVATTPFDFMDNESMLPDMYDEMMIGGGGPTEFETVQVTTEMATTSDNATTTNNGSGIGTPLIYEDGGGGGGGGGTVSLHGKSSGSDRGKHRSTWSPANHTFKTNYTYNYNKSRKFWWNKRQKVCRLMAVHSTDDLIRMGSEVGMFMGAFLYLLAAVREAGFLGTQMFIENLAIAPARVMFLFSCLLMMTIPPLRLTCYDKAEDIIAVIIMLTTCPYFLFFCRGFKTVGPFVVMIYRMVMGDLLRFVSIYMVFVMGFSQAYYVIFLSYDNPLTPEGIDDSVLNPMPTPTESIMAMFLMSVNTFTDYYTAFDKTSHTLVAKFCFIVFMVIVAILLVNMLIAMMGNTYQKIAETRNEWQRQWARIVLVVERGVSPSQRLIKLMYYSQPMSDGRRALVLRLNQTDEDKEQMKEILEMKRIHNRYVERMRARDLSSKLSSSCGKNANNGTFNLKANE

SEQ ID NO: 65 - protein, 707 aa, Dendroctonus ponderosae
MGNTESNVTSGVKKQAGAAMQPIYKLCDLKGGGLLVELMKRAAQNKQYAEIDHAIKTKVEHFLYNKGAGRYIPISQMVLLRNKERGKHKLLPQLRGMENPEDFEVDDEGPEITEEEYNKDPSLYRHVCWKLRERGAVGETILHLCLLNATSLHADIAKRLLRFYPKLINDIYISDEYYGENVLHIAIVNEDPSMVKFLLAANVNFQERCFGNFMCPEDQKSSRTDSLDHEWVNVYHETNYDGYVYWGEYPLSFAACLGQEESFRLILAKGANLDAQDTNGNTVLHLLVIYSKVEAFDMAYELGAHLSIRNILKMTPLTLAAKLARMDIFFHILKLEREIYWQIGSITCAAYPLSQIDTIDVKTGQISKMSALNLVVFGDKDEHLELLDGVLVDLLNAKWNTFVKSKFYRQFFTFAFYFTVSLVDTSNDDYDVEEWWDNLREECRLMNLDTTESLVRFTAELGITFGAFLYLAAAMTAPSRVMFLFSCILVFGVIPSLRLVCMDEVEDIIAVVVMLTTAPYFLFFCRGFKTVGPFVVMIYRMVLGDLLRFATIYMVFVMGFSQAYYIIFLSFDNPLTPEDVDDSATNPMSTPSESIMAMFLMSMTNFGDYYTAFARTEHEYEAKILFVIFMAIVAILLINMLIAMMGNTYQKIAETRNEWQRQWARIVLVVERGVSPPERLKQLNVYSQPMSDGKRALVLRLNQSVRY

SEQ ID NO: 66 - protein, 905 aa, Harpegnathos saltator
MGNTESNVTSGVKKQTDTSSIMLYKLVDLKGGGLFVDMMKRAAQTKQFAELDHAVRTKVEPYLYNKGKGKWIPVDKLVLLRNKDRPRHKMLAPLKAMENPADYDIDKDMGDEDVDETKIDKSKYRLVCWSLSERGAVGETILHLCMLNATALHADLAKRLLRFYPNLINDIYISDEYYGENVLHIAIVNEDPAMVKYLLDSGADVHERCFGNFMCPEDQKASRVDSLDHEWVCVAPETNYSGYVYWGEYPLSFAACLGQEECYRLMLARGADPDKQDTNGNTVLHMLVIYEKLTTFDMAYEVGASLAIRNVQHLTPLTLSAKLAKIEMFFHILNIEREIYWQIGSITCAAYPLSQIDTIDINIGTINKNSALNLVVFGEKDEHLELMDGMLVDLLNAKWNTFVKSRFYRQFFLFCFYFVLSLISFTLRPGPLPQETENANDTRTNSSNATAMEILRLFQSSDLSNLVTNSLAAAFASNLKSSLNVTQESLEKIQLQVTSNITSALKNILPSLSDNEGILSAPDEAAIRTLWYTSSPYNESDYLTDAYNENVTSDANSTAGTIIGSIEVSKSNDKDNWWEDLTEECRLMQLTTISAKIRLTAEVLMEIAAVLYILAALREARFLGLNMFVENLMTAPSRVMFLFSCCILLSFPFLRLACADEVEDMLAVVVMLTTAPYFLFFCRGFKTVGPFVVMIYRMIMGDLLRFVSIYLVFVMGFSQAYYIIFLSFDNPNTPEGVDDSVSNPMPSPMESIMAMFLMSMTNFGDYYGAFERTEHESEAKLLFVLYMAIVAILLVNMLIAMMGNTYQKIAETRNEWQRQWARIVLVVERGVSPAERLKKLMDYSQPMSGGRRALVLRLNQSEEDKEEMKEILEMKRTHDRLLKKRQGRMSKEKVLAESEIIITRN

SEQ ID NO: 67 - protein, 903 aa, Nasonia vitripennis
MGNAESNVTSGVKKQTDAGAIALYKLVDLKGGGLLVDMMKRASQTKQYAEIDHAIRTKVEPFLYNGGKGKWIPIAKLVLLRNKERGRHKMLPVLKAMEKPEDYDIDKDMANDPEPDENTIDKSKYKLVCWTLSDRGAVGETILHLCMLNATQLHADLAKRLLRFYPNLINDIYIDDEYYGENVLHIAIVNEDPSMVKFLLDSGANVNERCCGNFMCPEDQKASRNDSVEHEWVCVCSETNYDGYVYWGEYPLSFAACLDQEECYRLILAKGADPDSQDTNGNTVLHMLVIYEKLETFDMAYEVGSSLSIRNVLQLTPLTLAAKLARVEMFFHILNIEREIYWQIGSITCAAYPLSQIDTIDVDTGKISNNSALNLVVFGDKEEHLKLLEGVLIDLLNAKWNTFVKSRFYQQFYLFFCYFILSLISCTLRPGPITKTDAPTTTPHPMNDTSIESITPTSEPLELQTLSSLLAKNLAEQLVMGMKMYGNVSEDSLARISLQVASNISGSIKDIWTRQNLTSNDTDYVDIAGGLYADVNETSASDPFDLNASDIVILKKGKKELDDWWDDLTEDCRLMQMNSTSAKIRLTAEIFMEFGAILYICAALREARFLGLNMFIENLMTAPSRVMFLFSCCILLSFPFLRMSCADEVEDILAVVVMLTTAPYFLFFCRGFKTVGPFVVMIYRMIMGDLLRFVSIYLVFVMGFSQAYYIIFLSFDNPITPEGVDDSKANPLPSAMESIMAMFLMSMTNFGDYYDAFENTEHEMLAKCLFVVYMAIVSVLLVNMLIAMMGNTYQKIAETRNEWQRQWARIVLVVERGVAPAERLKKLNVYSQPMSDGRKALVLRLNQTDKDKEEMKDILEMKRIHIKSIKRRKDKLQKAKEDAEKLQQQMADKDNKDKAVIIQ

SEQ ID NO: 68 - protein, 903 aa, Megachile rotundata
MGNTESNVTSGVKKQTDSSSILLYKLVDLKGGGLLVDMMKRATQTKQYAELDHALRTKVEPYLYNKGKGKWIPIEKLVLLRNKDRPKHKMLPPLRAMENPADYDIDKDMGEEEVDETKIDKSKYRLVCWSLSQRGAVGETIMHLCMLHATAIHTDLAKRLLRFYPKLINDIYISDEYYGENALHIAIVNEDPAMVKFLLDSGADVHERCVGNFMCPEDQKASRTDSVDHEWVCVAPETNYSGYVYWGEYPLNFAACLGQEECYRLILARGADPDKQDTNGNTVLHMLVIYEKMATFDMAYEVGASLSIRNAQHLTPLTLSAKLARIEMFFHILNIEREIYWQIGSITCAAYPLSQVDTIDVNTGSISHTSALNLVVFGEKDEHLELMDGTMVDLLNAKWNTFVKSRFYRQFFLFCFYFILYLISFTLRPGPSVTSTATTAPTTESTTPKLPDPPPNFIPVTNQKTFLEASLSSSLDEIVTNALNLNFPSNATARFDDLKLDLVTHIMSNLKNILNGNETKNEPFNSSQLARFDKHLFRENDTDYSTSILNETADVDSTTKFSFDNSVLFEADNKSDWWTDLTTECRLMQLTTASAKIRLIAEIFMEIAAILYILAALREARFLGLNMFIENLMTVPSRVMFLFSCCILLSFPFLRLSCADEVEDVLAVVVMLTTAPYFLFFCRGFKTVGPFVVMIYRMIMGDLLRFVSIYLVFVIGFSQAYYIIFLSFDNPNTPEGVDDSVSNPMPSPIESIMAMFLMSMTNFGDYYGAFERTRHEMEAKFLFVVYMAIVAILLVNMLIAMMGNTYQKIAETRNEWQRQWARIVLVVERGVSPQERLKKLMDYSQPMSDGRRALVLRLNQSEEDKEEMKEILEMKRTHERLYKKRQLKTTKEKTTITEENVTL

SEQ ID NO: 69 - protein, 887 aa, Apis mellifera
MGNTESNVASGVKKQTDASSILLYKLVDLKGGGLLVDMMKRATQTKQYAELDHALRTKVEPYLYNKGKGKWIPIEKLVLLRNKDRPKHKMLPPLRAMENPADYDIDKDMGEDEVDETKIDKSKYRLVCWSLSERGAVGETILHLCMLHATAIHIDLAKRLLRFYPKLINDVYISDEYYGESALHIAIVNEDPSMVKFLLDSGADVHERCIGNFMCPEDQKASRADSLDHEWVCVTPETNYNGYVYWGEYPLNFAACLGQEECYRLILARGADPDKQDTNGNTVLHMLVIYEKLATFDMAYEVGASLAIRNAQHLTPLTLSAKLAKIEMFFHILNIEREIYWQIGSITCAAYPLSQVDTIDVDTGSISHNSALNLVVFGEKDEHLELMDGILVDLLNAKWNTFVKFRFYRQFFLFCFYFVLSLISFTLRPGPATTSSVSNPQITSTELPTIPPKMDPPVHNSDLPLLLDKILSTALVSKRYPWNLTRTRLDKLKLDIVENLTSALSDMLGTYRNEIKLFNRSDKTSIYSSRNDAKPIDETVLRINSTILFNGDGISFTSKYNWWNNLTEECRLMHLDTLSTKIRLTAEVLMEIAATLYIFAALREARFLGLNMFIENLMTAPSRVMFLFSCCILLTFPFLRLICADEIEDMLAVVVMLTTAPYFLFFCRGFKTVGPFVVMIYRMIMGDLLRFVSIYLVFVMGFSQAYYIIFLSFDNPNTPEGVDDSMSNPMPSPIESIMAMFLMSMTNFGDYYGAFERTQHEMEAKFLFVVYMAIVAILLVNMLIAMMGNTYQKIAETRNEWQRQWARIVLVVERGVSPDERLKKLMDYSQPMSDGRRALVLRLNQSEEDKEEMKEILEMKRTHDKLYKRRQSKTMKKILTSEDNVIL

SEQ ID NO: 70 - protein, 912 aa, Apis florea
  MOD_RES (414)..(414): Any amino acid
MGNTESNVASGVKKQTDASSILLYKLVDLKGGGLLVDMMKRATQTKQYAELDHALRTKVEPYLYNKGKGKWIPIEKLVLLRNKDRPKHKMLPPLRAMENPADYDIDKDTGEDEVRDETRIDKSKYRLVCWSLSERGAVGETILHLCMLHATAIHIDLAKRLLRFYPKLINDVYISDEYYGESALHIAIVNEDPSMVKFLLDSGADVHERCIGNFMCPEDQKASRADSLDHEWVCVTPETNYNGYVYWGEYPLNFAACLGQEECYRLILARGADPDKQDTNGNTVLHMLVIYEKLATFDMAYEVGASLAIRNAQHLTPLTLSAKLAKIEMFFHILNIEREIYWQIGSITCAAYPLSQVDTIDVDTGSISHNSALNLVVFGEKDEHLELMDGILVDLLNAKWNTFVKFRFYRQFFXFCFYFVLSLISFTLRPGPATTSSVPNPVAQTPLTSTELSTISPKVDPPVSNVTVNRSSNAFQHDSNLSLLLDKILSTASVKYPWNVTRTRLDKLKLDIIENLTTALNNLLSTHRDEIEFFNHSYKTTEYFHSTRNDTTPIDNLKITINETVLSVNSTILFNDGISFATGKYNWWNNLTEECRLMHVDTLSTKIRLTAEVLMEIAATLYIFAALREARFLGLNMFIENLMTAPSRVMFLFSCCILLTFPFLRLICADQVEDMLAVVVMLTTAPYFLFFCRGFKTVGPFVVMIYRMIMGDLLRFVSIYLVFVMGFSQAYYIIFLSFDNPNTPEGVDDSMSNPMPSPIESIMAMFLMSMTNFGDYYGAFERTQHEIEAKFLFVVYMAIVAILLVNMLIAMMGNTYQKIAETRNEWQRQWARIVLVVERGVSPEERLKKLMDYSQPMSDGRRALVLRLNQSEEDKEEMKEILEMKRTHDKLYKKRQSKIMKKILTSEDNVIL

SEQ ID NO: 71 - protein, 823 aa, Pediculus humanus
  source: /note="Pediculus humanus corporis"
MGNTESNVTSGVKKQAGTSEQPLYKLVGLKGGGLLVDMMKRATQTKQYAELDHAIKTKIEPFLYNKGKGRLIPISQLVLLRNCERSRTKLLPLLKNMEDPESEFDMDRDGNPGDFQPAPDGVQEDFHDYNKKYRDVCWDLKKRGAVGETCLHLCMLNATSIHADLAKRLLKFYPKLINDIYMSDEYYGESVLHVAIVNEDPAMVKYLLDSGSNFHERCFGNFMCPEDQKATRTDSLDHEYVNLSTETNYEGYVYWGEYPLSFAACLGQEESYRLMLAKGANPDNQDTNGNTVLHMLVIHNKLPMFDVAYEVGANLSLKNAKCLTPLTLAAKLARVELFFHILNIEREIYWQIGSITCAAYPLSQIDTIDIETGNISKNSALNLVVFGEKDEHLELMDGVLVDLLVAKWNTYVKFRFYRQFISFFFYFLISVICFTLRPGPPTGTTTTTNGIVVLNNNNNNITSVVDNSNNVTTTTATTTATSYSFPGHVIVTLLSYDKYEDKIRIISELAMEIGSVLYLLGALREAKFLGIHMFIENLMTAPSRVLFLGSCCIMQFVPWLRITCKEETEDIVAVIIMLTTAPYFLFFCRKMNDPVFLFLFFLIKKIFFLIFFFFFFTKPTYYIIFLSFDNPKTPDGVDDSGTNPMQSPVESIMAMFLMSLTNFGEYYGAFEKTEHEFVAKLMFVVYMAIVAILLVNMLIAMMGNTYQKIAETRNEWQRQWARIVLVVERGVSPQERLKKLMLYSQPMSDGRRALVLRLHQTPEDKEEMKEILDMKRIHNRTVQRRKAKENKNVTFAGTPKNGIKNRLLGPVPPLKSIPSKPKI

SEQ ID NO: 72 - protein, 355 aa, Danaus plexippus
MLESGGGLLVDMMKRAVQNKQYAEIDHAIKTKVEPFLYNKGKGRHIPISHLVLLRNKERGRHKLLPPLRGMENPDEEFDVEKDWPVVTQEEYEANPSAYRELCWDLKERGAVGETILHLCLLNATSLLADLAKRLLRFYPKLINDIYMSDEYYGESVLHMTIVNEDPTMVKFLLDSGADYHERCFGNFMCPEDQKASRTDSFDHEWVNVQPDTNYDGYVYWGEYPLSFAACLGQEECYRLILARGANPDKQDTNGNTVLHMLIIYDKISTFDMAYEVGASLNIRNVQNLTPLTLAAKLARVELFFHILNIEREIYWQIGATTCAAYPLGQVDTIDTETGRISKDSALNLVVFGVS

SEQ ID NO: 73 - protein, 861 aa, Solenopsis invicta
GGLLVDMMKRASQTKQYAELDHAMRTKVEPFLYNKGKGKWIPIEKLVLLRNKDRPRHKMLPPLKAMENPADYDIDKDMGDEEVDEAKIDKSKYRLVCWNLSDRGAVGETILHLCMLNATAIHADLAKRLLRFYPLLIYDIYLCDEYYGENVLHIAIVNEDPSLVKFLLDSGADDPRIIHERCFGTFMCPEDQKASRFDSMDHEWVCVTPETDYNGYVYWGEYPLSFAACLGQEECYRLILARGADPDKQDTNGNTVLHMLATFDMAYEVGASLDIRNVQHLTPLTLAAKLARIEMFFHILNIEREIYWQIGSITCAAYPLSQIDTIDVNTGTINKTSALNLVVFGDKDEHLELMDGMLVDLLNAKWNTFVKSRFYRQFFLFCFHFVLSLISFTLRPGPSTMETDENANDTSTKTNSSNITEPIILKPLQSSDLSELVTNSFVAAFASNLKSSLNMTQESLEKIQLQVTSNITSALKSILLLTLNENEGILSPPDEATIHTPWYTDSSPNTSDYFTDLYNKTVVAENSTVKAVVDDVAQTDYWWDDFAEECRLMQLTETSAKIRLTAETFMYIAAVLYILAALREARFLGLNMFIENLATAPSRVMFLFSCCILLSFPFLRFVCADEIEDILAVVVMLTTAPYFLFFCRGFKTVGPFVVMIYRMIMGDLLRFVCIYLVFVMGFSQAYYIIFLSFDNPNTPEGTDDSITNPMPSPMESVMAMFLMSMTNFGDYFGAFERTEHEFEAKLLFVLYMVIVAILLVNMLIAMMGNTYQKIAETRNEWQRQWARIVLVVERGVSPAERLKKLTDYSQPMSDGRPALVLRLHQTEEDKEEMKEILEMKRTHEKLLKKRQCRMSKEKILS

SEQ ID NO: 74 - protein, 861 aa, Acromyrmex echinatior
MGNTESNVASSVKKQTDTSSILLYKLVDLKGGGLLVDMMKRATQTKQFAELDHAMRTKVEPFLYNKGKGKWIPVDKLVLLRNKDRPRHKMLPPLKAMENPADYDIDKDMGDEEVDEAKIDKSKYRLVCWNLSDRGAVGETILHLCMLHATAIHADLAKRLLRFYPKLINDIYLSDEYYGENVLHIAIVNEDPSMVKFLLDSGADDPCIIHERCFGNFMCPEDQKASRFDNMDHEWVCVSPETNYNGYVYWGEYPLSFAACLGQEECYRLILARGADPDKQDTNGNTVMHMLATFDMAYEVGASLGIRNVQHLTPLTLAAKLARIEIFFHIMNIEREIYWQIGSITCAAYPLSQIDTIDVNTGTINNNSALNLVVFGDKDEHLELMDGVLVDLLNAKWNTFVKSRFYNQFFLFCFYFVLSLISFTLRPGPSTIETDENANDTSTRTNSSNITEPIIHKTLQSSDLSELVTNSLVAAFTSNFKSSLNMTQESLEKIQLQVTSNITSALKSILLLTLNENEGILSPPDEATIHTLWYTDSPPNASDYFMNTYNKTDANSTVKTIIDGVARPKFKSNYWWDDFSEECRLMQLSEMSAKIRLTAEIFMFIAAVLYILAALREAKFLGLHMFIENLMTVPSRVMFLISCCILMWFPVLRFTCSDEVEDMLAVVVMLTTAPYFLFFCRGFKTVGPFVVMIYRMIMGDLIRFVSIYLVFVMGFSQAYYIIFLSFDNPNTPEGIDDSITNPMPSPMESVMAMFLMSMTNFGDYFGAFDRTEHEFEAKLLFVLYMAIVAILLVNMLIAMMGNTYQKIAETRNEWQRQEEDKEEMKEILEMKRTHDRLLKKRQNRMSKEKIIFETEPIITKN

SEQ ID NO: 75 - protein, 904 aa, Camponotus floridanus
MGNTESNVTSGVKKQTDTSSIVLYKLVDLKGGGLLVDMMKRATQTKQFAELDHAMRTKVEPFLYNKGEGKWIPIDKLVLLRNKDRPRHKMLAPLKAMENPADYDIDKDMGDEEVDETKIDKSKYRLVCWNLSERGAVGETILHLCMLNATALHADLAKRLLRFYPKLINDIYLCDEYYGENVLHIAIVNEDPSMVKYLLDSGADDPRIIHERCFGNFMCPEDQKASRFDSQDHEWVCVTPETNYNGYVYWGEYPLSFAACLGQEECYRLILARGADPDKQDTNGNTVLHMLATFDMAYEVGASLDIRNVQHLTPLTLAAKLARIEMFFHILNIEREIYWQIGSITCAAYPLSQIDTIDVNAGTINNNSALNLVVFGEKDEHLELMDGVLIDLLNAKWNTFVKFRFYRQFILFYFYFVLSLISFTLRPGPQTDENANDTLTNSFNTTRESMILKSLHSSDLSELVTNSFTAAFTSNFKSSLNVTQESLEKIQLQVTSNVTSALRSILLLTLSNNEDLLSSPDEAAIHTLWYTDNPQNASDYFINMYNKTVTIDTNSTAKTTIDDVTLLGKFNNHEKWWDDLTEECRLMQLTTMSAKIRLTAEIVMYFAAVLYILAALREARFLGLNMFIENLMTAPSRVMFLFSCCILMSFPVLRLSCSDEVEDVLAVVVMLTTAPYFLFFCRGFKTVGPFVVMIYRMITGDLLRFVSIYLVFVMGFSQAYYIIFLSFDNPNTPEGVDDSITNPMPSPMESVMAMFLMSMTNFGDYYATFDRTEHEFEAKLLFVLYMAIVAILLVNMLIAMMGNTYQKIAETRNEWQRQWARIVLVVERGVSPAERLKKLMDYSQPMSDGRKALVLRLNQTEEDKEEMKEILEMKRTHDKLIKKRQDKILKEKALAETEAVITRK

SEQ ID NO: 76 - protein, 849 aa, Myzus persicae
  MOD_RES (70)..(213): Any amino acid
  MOD_RES (300)..(328): Any amino acid
  MOD_RES (621)..(628): Any amino acid
AIKTQVEPMLYNKGEGRMIPIAKLVLLRNRDRSRARWLPPLKNMEDANEYDIEKDIPTIEELEKLGEVQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXARGADPNNQDTNGNTVLHMLVIYEKISTFDMAYEIGAELNIRNVQNLTPLTLAAKLARIQMFFHILKIEREIYWQIGSITCAAYPLXXXXXXXXXXXXXXXXXXXXXXXXXXXXXHLEMMDGVLVDLLNAKWNAFVKFRFYRQFILFAFYFSISMVCFVLRPGPPPTGLKPPLINYTSTSTTVATTPFDFMDNESMLPDNVMYDEMMIGGGGPTEFETPVVTTEMATVNDNATTNNGTGIIRTPLIYEDGAGGGGGSGTVSLHGKSSGSDRGKHRSTWNPANHTFKTNYTYNYNKSRKFWWNKRQKVCRLMAVHSTDDLIRMGSEVGMFVGAFLYLLAAVREAGFLGSQMFIENLAIAPARVMFLFSCLLMMTIPPLRLTCYDKAEDIIAVIIMLTTCPYFLFFCRGXXXXXXXXVMIYRLVMGDLLRFVSIYMVFVMGFSQAYYVIFLSYDNPLTPEGIDDSVLNPMPTPTESIMAMFLMSVNTFTDYYTAFDKTSHTLVAKFCFIVFMVIVAILPVNMLIAMMGDTYQKIAETRNEWQRQWARIVLVVERGVSPSQRLKKLMYYSQPMSDGRRALVLRLNQTDEDKEQMKEILEMKRIHNRYVERMRARDLSSKLSSSCGKNANDGTINLKANK

SEQ ID NO: 77 - protein, 833 aa, Bemisia tabaci
  MOD_RES (293)..(573): Any amino acid
DPEKIDPKKCREVCWDLMERGAVGETILHLCLLNATSIHADLAKRLLRFYPKLINDIYMCDEYYGESVLHIAIVNEDPAMVKFLLDSGADYHERCTGNFMCPEDQKATRQDTVEHEWVNLSPLTNYEGYVYWGEYPLSFAACLGQEECFRLMLARGANPDNQDTNGNTVLHMLVIYEKLETFDMAYEVGANISVRNVQNLTPLTLAAKLARIEMFFHILNIEREIYWQIGSIACAAYPLGQIDTIDIETGHISKNSALNLVVFGDKDEHLELMDGVLVDLLNAKWNAFVKLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIMLLTSPYFLFFCRGFKTVGPFVVMIYRMVMGDLLRFVSIYMVFVMGFSQAYYIIFLSFDNPSTPDGVDDTVSNPMPNPVEAGMAMFLMSLNTFGDYFSAFEKTEHELEAKVCFVIFMGIVAILLVNMLIAMMGNTYQKIAETRNEWQRQWARIVLVVERGVPPKERLTKLMWYSQPMSDGRRALVLRLNQTEQDKEEMKEILEMKRVHNRIVEKRQKRLAKLSNNASPSNKPLVDLPNLSNHDSPTKPLLDLASNLSKF

SEQ ID NO: 78 - protein, 748 aa, Euschistus heros
  MOD_RES (102)..(102): Any amino acid
LRFYPKLINDVYMSDEYYGESVLHIAIVNEDPAMVKFLLDSGVNVNERCFGNFMCPEDQKASRTDSLDHEWVNLQSFTTYEGYVYWGEYPLSFAACLGQEEXYRLMLARGANPDNQDTNGNTVLHMLVIYCKIQTFDMAYEVGGDLSIRNVQYLTPLTLAAKLARIELFFHILNIEREIYWQIGSITCAAYPLSQIDTIDIVTGNISKNSALNLVVFGEKDEHLELMDGVLIDLLNAKWNAFVKFRFYRQFFLFLFYFLISLICFTLRPGPPPVKPISSFNSTKPSGNNITAELSPESNATTVPKWIYKTEIKKYDPEDNSSQNSRLNVILREVILTSLKVEDIDKVVSFSNAEPQDNSREDADGLVCNGDSVHSCLGNGSDVVAVFGKGKSPKVPKPGASADDFDYDDTWWEEFGQCRLLQVTSYIEMTRLISEVLLDIGALLYILAALREARFLGWSMFVENLMTAPSRVMFLFSCCLMLTMPFLRFTCNEEIEDMMAVIIMLTTAPYFLFFCRGFKTVGPFVVMIYRMIMGDLLRFATIYLVFVMGFAQAYYIIFLSFDNPLTPEGVDDSVSNPIPNPMEAVMAMFFMSMTSFGDYYPALERTAHEFCAKLCFVIYMAIVAILLVNMLIAMMGNTYQKIAETRNEWQRQWARIVLVVERGVSPSERLTKLMWYSQPMSDGRRALVLRLNQSEEDKEEMKEILEMKRIHNRMVQKRKEREKSMNKSPNLINLNSPAENVKNTNPFS

SEQ ID NO: 79 - protein, 734 aa, Nilaparvata lugens
  MOD_RES (183)..(183): Any amino acid
  MOD_RES (322)..(322): Any amino acid
LHMAIVNEDPGMVKFLLNSGADFHERCFGNFMCPEDQKASRSDSFDHEWVNLWPVTNYEGYVYWGEYPLSFAACLGQEECYRLMLARGANPDNQDTNGNTVLHMLVIYEKMGTFDTAYELGANVSVRNIQNLTPLTLAAKLARIEMFFHIMNIEREIYWQIGSITCAAYPLMLIDTIDIETGXISKDSALNLVVFGDKDEHLDLMEGVLVDLLHAKWNAFVKFRFYRQFIMFFQYFLISCVCFILRPGPPEAHDGMNITANATLNLSFGVLEVRPEALQALLYRLEKLSLPQSGDLERFILESLADEKSISEAALENDENRXPGWNNSVFSTYETLARDTGYQTDESPHDGLSSSMDYAEVAERLTKLMIDVNLTERSGAVNEIILKALPSLEEKEDGLEEWWSGIAGDCILLQVNDLYDLARLCAEVALEIGAFLYLLAALREARFLGLKMMIENLMTAPSRVMFLFSCCLMMTMPFFRFTCQDETEDILAVVIMLTTGPYFLFFCRGFKTVGPFVVMIYRMVMGDLLRFVSIYMVFVMGFSQAYYIIFLTYDNPTTPEGTDDTTSNPLPSPIEAIMAMFFMSLTNFGDYYSAFENTEHEIEAKAFFVIYMVIVAILLINMLIAMMGNTYQKIAETKNEWQRQWARIVLVVERGVSPKERLKKLMSYSQPMSDGGRALVLRLNMTEEDKEEMKEILEMKRVRDKIVMKRKKGLKLLGTTTPSPKRMKGRETPI

SEQ ID NO: 80 - protein, 162 aa, Schistocerca americana
LHMAIVNEDPAMVKFLLDSGANVHERCFGTFMSPEDQKAQRSDSLDHEWVNVNSDTNYEGYVYWGEYPLSFAACLGQEECYRLVLAKGANPDSQDTNGNTTLHMLVIHRKMTQFDMAYEVGSSLDIKNNLNLTPLTLAAKLARIEMFFHILNIEREIYWQIG

SEQ ID NO: 81 - protein, 1123 aa, Drosophila melanogaster
MKFLLKKCLRKKAPEMKPGAILDAVISQSSATACKCLLYKLADYKRGGDLIDAINSGGLIAVEQLIREQFGVFMYNDGKGQVINRAEFLRWKYRDHTEVTIPIEASLSIHDPLGKWEDHKACWQMQYRGALGESLLHVLIICDSKVHTKLARVLLRVFPNLALDVMEGEEYLGASALHLSIAYSNNELVADLIEAGADIHQRAIGSFFLPRDQQRANPAKSTDYEGLAYMGEYPLAWAACCANESVYNLLVDCGSDPDAQDSFGNMILHMVVVCDKLDMFGYALRHPKTPAKNGIVNQTGLTPLTLACKLGRAEVFREMLELSAREFWRYSNITCSGYPLNALDTLLPDGRTNWNSALFIILNGTKPEHLDMLDGGIIQRLLEEKWKTFAQNQFLKRLLILSTHLLCLSVSVYLRPAHDGEAEDEDSEGSDASAAALLDIQSDEGDSGGGDYNAQTVARYCAEFATLVGVLSYVIFQQGDEIKNQGLSAFLKQLSHAPAKAIFLFSNLLILACIPFRLIGDTDTEEAILIFAVPGSWFLLMFFAGAIRLTGPFVTMIYSMITGDMFTFGIIYCIVLCGFSQAFYFLYKGHPQVQSTMFNTYTSTWMALFQTTLGDYNYPDLNQTTYPNLSKTVFVIFMIFVPILLLNMLIAMMGNTYVTVIEQSEKEWMKQWAKIVVTLERAVPQADAKGYLEAYSIPLGPSDDSGFEVRGVMVIKSKSKTRAKQRKGAVSNWKRVGRVTLTALKKRGMTGEEMRRLMWGRASISSPVKVTKQKLKDPYNLHTDSDFTNAMDMLTFASNPASSNGVTLRSVTAPPPAPPAPDPFRELIMMSDQRPETHDPHYFAGLQQLANKAFDLVEQTMKTQPQAPVAKKVDPLPVASVAKASPAAPATQATATAAAASDLMAMPLPISNLSNLFQDPKDIVDPKKLEEFMAMLAEVETEESDSGGPILGKLSLAKRTHNALSKAEIRRDQQGFEGHSHGQFQPMSSVWAPPGLDVDTGFHFDEAVAEEVLTIEQEAEVETEDGNGGQDSEDIPTAEEVHATMKQFHLRKCQPAQDEAARRAKSARVRRRNKVSPEQSDDPDERSQRGRSAYTRRTQSPPDPLEPWSTRELQDINKILARK

SEQ ID NO: 82 - protein, 1128 aa, Musca domestica
MRLFMKKCLRKKPQELKPGAILDAVISQSSATASKCLLYKLADYKRGGDLIDAINTGGLVAVEQLIREQFGIFMYNDGKGQVINRAEFLRWKYRDHTEVTIPIEASLSIHDPLGKWKDHSACWQMQYRGALGESLLHVLIICDSKMHTKLARILLRVFPRLALDVIEGEEYLGASALHLAIAYSNNELVADLIEAGADINQRAIGSFFLPKDQQRANPAKSTDYEGLAYMGEYPLSWAACCANESVYNLLIDHDADPDAQDSFGNMILHMVVVCDKLDMFGYALRHPKTPAKNGIVNHSGLTPLTLACKLGRAEVFREMLELSAREFWRYSNITCSGYPLNALDTLLPDGRTNWNSALFIILNGTKEEHLDMLDGGIIQRLLEEKWKTFAQNQFLKRLLILVVHLLCLSTSVYLRPAHDGDDDEEDETAQANAGLQTNDPENEEYDIQTIVRYCAELCTIAGVLSFLIFQQGDEIKNQGLSAFLKQLSHAPAKVIFLVSNLMILACIPFRLMGDTDTEEAILIFAVPGSWFLLMFFAGAIRLTGPFVTMIYSMITGDMFTFGIIYSIVLCGFSQAFYFLYKGHPQLQSTMFDTFPSTWMALFQTTLGDYNYPDLNQTTYPNLSKTVFVIFMIFVPILLLNMLIAMMGNTYAHVIEQSEKEWMKQWAKIVVTLERAVPQADAKNYLEAYSIPLGPSDDSGFEVRGVMVIKSKSKTRAKQRKGAVSNWKRVGRVTLNALKKRGMTGEEMRRLMWGRASISSPIKVAKKKLKDPYNLNQEPGGQSNLTSAMDMLNFANDPASSSGLAFRTSGTQDPKEKKDVPHIPAPDPLRDLVLLAEEKPEVHDPQFYSALIQLANKAYDLVKKTLETQHQPQVEEPIPLTEATSLKDVTLTKQPDPVAADAGLLGDMAMGANLTNLFQDPKDIVDPKKLEQFLKMVADVETEESDGGGPILGKLSLARRTRNALFKVPIPKSTLGDSSDKLINSVWDKVPADNDEDSIPAFDFQEALAEHVLTVEQEADVETEDANDDSGETMDDIPTAEEVHATMKQFHLRKRQYQQDDAARRAKTARIRRKNKVAPDYAGSEEQYGRGRSAPMKKKHDEDEMSPPDPLEPWSTRELQNINKILAKK

SEQ ID NO: 83 - protein, 1144 aa, Ceratitis capitata
MKFFLKKCLRKKPEEMKPGAILDAVISQSSPMANKCLLYKLADYMRGGDLIDALNTGGLVAVEQLIREQFGIFMYNDGKGQVINRAEFLRWKYRDHTEVTIPIEASLSRHDPLGKWEDHKACWQMQFRGALGESLLHVLIICDSKIHTKLARVLIRVFPNLAQDVMEGEEYLGASALHLAIAYSNNELVADLIEAGADINQRAIGSFFLPRDQQRRNPAKSTDYEGLAYLGEYPLAWAACCANESVYNLLVDCGADPDAQDSFGNMILHMVVVCDKLDMFGYALRHPKTPAKNGIANHSGLTPLTLSCKLGRAEVFREMLELSAREFWRYSNITCSGYPLNALDTLLPDGRTNWNSALFIILNGTKEEHLDMLDGGIIQRLLEEKWKTFAQNQFLKRLLILVIHLVFLSISVYMRPARVADDDDEDEIDASSKDTKALELATELDEDEYDVQTIVRYCAEFGTIVGVLSYVIFQQGDEIKNQGLPAFLKQLTHAPAKAIFLVSNLLILACIPCRLMGDTDAEEAILIFAVPGSWFLLMFFAGAIRLTGPFVTMIYSMITGDMFTFGIIYCIVLCGFSQAFYFLYKGHPQIQSTMFNTFPSTWMALFQTTLGDYNYPDLNNTTYPNLSKTVFVIFMIFVPILLLNMLIAMMGNTYAQVIERSEKEWMKQWAKIVVTLERAVPQADAKNYLEAYSIPLGPIDDSGYEVRGVMVIKSKAKTRAKQRKGAVSNWKRVGRVTLNALKKRGMTGEQMRRLMWGRASISSPIKITKKKLKDPYNLNPQNDLTSAMDMLTFANDPAASAGLQLRSSLMDSGAEGKAAKVQEENQQPAPDPLRDLIFLADRRPEMHDPQYFVGLQQLANQALDLVEQTMGIHPPPTPATDALLLSAAAATTTIGAVTMQTATTVAAPSADLITPLGANLTTLFQDNKDVVDPQKLQEFLKMLAEIETEESDGGGRPILGKLSLSRRTKSALSKAQIKKDTVGGSPDKLIPSVWSHNLPQPDEEPEFNFEAALAEEHTLTIEQEAEVETETGNEREDSEDCPTVEEVHATMKQFHLRKRQYQQDDAARRAKSARIKRKNRISPEQSHECDDGSSGGGGGKSTHPRGASAPGRKHTVSERLSPPDPLEPWSTRELQNINKILARK

SEQ ID NO: 84 - protein, 1120 aa, Aedes aegypti
MVQFDWRRMCRKKRKVPQGGAILDQVISQSANASNQCLLYKMANYKRGGDLIDAFQVGGQKAVEQLIREQFGVFMYNNGRGQIINRAEYLRWKYMDNHEVVIPIEASLSPHDPLGKWVDHKACWQMQYRGLLGESLLHVLIICDTKIHTKLARILLRVFPELSIDVMEGEEYLGASALHLAIAYSNNELVGDLIDAGADVSQRAIGRFFLPRDQQGLKPAKNTDYEGLAYLGEYPLAWAACCANESVYNLLLECGADPNAQDSFGNMILHMVVVCDKLDMFGYALRHPKLPCKNGIVNESGLTPLTLACRLGRDEVFREMLELSAREFWRYSNITCSGYPLNALDTLMPDGTTNWNSALFIILNGTKEEHLNMLDGGIVERLLDEKWKTFARNQFIKRLLILALHLFCLSCSVYLRPVRVFKEESEEGSDGGDGAGTAAPDGVDDDEDIDLTTWFRYGFEIATVMGVLSYVVLQQGDEIKNQGLISFIKSLGNAPAKAIFLISNLMILACIPFRMMGDVEHEEAILLFAVPGSWFLLMFFAGAIGLTGPFVTMIFSMITGDMFTFGIIYMIVLFGFSQAFYFLYKGHPEAEDSPFGSYFGTWMGLFQTTLGDYDYADLNLTTYPNLAKTVFIIFMIFVPILLLNMLIAMMGNTYAYVIEQAEKEGMKQWAKIVVNLERAVKQEDAKKYLEEYSIGLGPSDDPRYEIRGVMVIKSKSKTRARQRKGAVSNWKSVLRVTLNELKKRNMTGEELRRIMWGRSSITSPAKISKKKKIYEEEDPFAITNAIDVMSFTQDIVMVSSEPTGPPTIDPSKPATIAVKPQTAPAAQPIPEIPPQPPLVKRQSVVSAPPAYDDFPPMKDYKDPLRELVIISESPSVDDHYVQSCKTLANDASTLDHDTLGQLNPFLEAKDVVDPVKEREFLKTLEALEDTDSEAAEKPVLGKISLIRRAKSAVSRTTSRKKKTDQHPLFTIAWDDKNLTRTHPEDFGALNTAYEYSAEDFKQDVDEEAREEEEDEGVTVEEVHRRMEELHHRGRASLERDSNSTESSKKHPHRKRQGMGRGRNNKVSPDTSNESVSGKKDKRMKSAPTGGGTSPPDPLEPWSTRDICNINKLLDTDTQDE

SEQ ID NO: 85 - protein, 1137 aa, Culex quinquefasciatus
MVKFDWRRMCRKKKNVPQGGAILDQVISQSTNVQGQCLLYKMANYKGGGDLIDAFKMGGQKAVEQLIREQFGVFMYNAGRGQIINRAEYLRWKYMDNHEVVIPIEASLSPHDPLGKWVDHKACWQMQYRGLLGESLLHVLIICDTKIHTKLSRILLRVFPELSIDVMEGEEYLGASALHLAIAYSNNELVGDLIDAGANVSQRAIGRFFLPRDQQKMHPAKTTDYEGLAYLGEYPLAWAACCSNESVYNLLLECGADPNAQDSFGNMILHMVVVCDKLDMFGYALRHPKLPCKNGIVNEAGLTPLTLACRIGRDEVFREMLELSAREFWRYSNITCSGYPLNALDTLMPDGSTNWNSALFIILNGTKEEHLNMLDGGIVERLLDEKWKTFARNQFLKRLLILALHLFCLSCSIYLRPVHVFKDDDDADDTDGVTDSPDTTDDEGIDLTTWFRYGFEVATVMGVLSYVVVQQGEEIKNQGFISFLKSLAGAPAKAIFLISNLMILCCIPLRILGDREAEEAVLLFAVPGSWFLLMFFAGAIGLTGPFVTMIFSMITGDMFTFGIIYTIVLFGFSQAFYFLYKGHPNADESPFGTYFGTWMGLFQTTLGDYDYADLNLTTYPNLAKTVFITFMIFVPILLLNMLIAMMGNTYAYVIEQAEKEGMKQWAKIVVNLERAVKQEDAKKYLEEYSIGLGPSDDPRFEIRGVMVIKSKSKTRARQRKGAVSNWKSVLRVTLNELKKRSMTGEELRRIMWGRSSITSPAKISKKKKIYDEDEDPFAITAAIDVMSFTQDIVMVSTEPVGPLMIDPTKPPVTTVKPTAPTVPSAQPAPGVPMTTAQTAAPTAPQLVKRQSVVSAPPAYDDFLPAKGFKDPLRELLILSESTSIDEHYAQTCRSLATDASTLDHEEHQQQQQQTVGQLNPFLDAKDVVDPVKEREFLKTLEALEDTDSEAAEKPVLGKISLIRRARSAVSRTTSRKKKTDQHPLFMIAWDDKTTTIPGGGPQAVSATAGTAAPEDDFGALNTAYECSAEDLKHDVDEEAREDDPDEGVTVEEVHRRMERFHQRPGRSSPERDSNSTESSKKQAKGDKRMKSAPSGHGPRHRQMMDTGGGSPPDPLEPWSTKEIVPINKLLDTDTQDE

SEQ ID NO: 86 - protein, 1216 aa, Anopheles gambiae
MVHLDPLRLCRKKRKLPQGGAILDQVISQSASASNQCLLYKMANYKRGGDLIDAFQIGGQKAVEQLIREQFGVFMYNKGRGQIINRAEYLRWKYMDNHEVIIPIEASLSPHDPLSKWDDHKACWQMQYRGLLGESLLHVLIICDTKVHTKLARILLRVFPEQSIDVMEGEEYLGASALHLAIAYSNNELVGDLIDAGADVSQRATGRFFLPRDQQGLRPAKTTDYEGLAYLGEYPLAWAACCANESVYNLLLECGADPNAQDSFGNMILHMVVVCDKLDMFGYALRHPKLPCKNGIVNAAGLTPLTLACRLGRDEVFREMLELSAREFWRYSNITCSGYPLNALDTLMPDGSTNWNSALFIILNGTKEEHLNMLDGGIVERLLDEKWKTFARNQFIKRLLILAIHLFCLSCSVYLRPVRVFADDEGEEGGDATDDDGADDGGPMAVDAVDDDIDLTTWVRYGFEVATVMGVLSYVVLQQGDEIKNQGFFSFLKSLSQAPAKAIFLISNILILACIPLRMMGDTETEEAILLFAVPGSWFLLMFFAGAIGLTGPFVTMIFSMITGDMFTFGIIYMIVLFGFSQAFYFLYKGHPNAEDSPFGSYFGTWMALFQTTLGDYDYADLNLTTYPNLAKTVFVIFMIFVPILLLNMLIAMMGNTYAYVIEQAEKEGMKQWAKIVVNLERAVTQDDAKRYLEEYSIGLGPSDDPRYETRGVMVIKSKSKTRARQRKGAVSNWKSVLRVTLNELKKRSMTGEELRRIMWGRSSITSPAKIAKKKRPGEVDDLLGDPFAITAAIDVMSFTQDIVMVSTDTVCPITIPPAAAPGTAAPKAGGTKPVVVAPPPPAAATAVQQPPPPATTRRHSTASAPATMGLGVEAALPGYKDPLRELVIISESASVDENYAQNVKTLAIDASTLDHVHEIDISQQQQQQQQQQQQQPQQPQQQQNLGQLTLFQNPKDVVDPVREREFLKTLEALEDTDSEAGEKPVLGKISLIRRAKSAVSRSTSRKRKTDQHPLFMIAWEDKGDQQRHSTALYDGATGAAPSVGAPGELGQPEQPEDAVTVEELHRRMEQFHQRASVRERDANSSESGSGKQHAGPKARKPSHHRDGGGSHHHHGLGRGKHNKISPDNSNESTGGGGGGGASGHGRKQDKRMKSAPILGSGGAGSAGSSAGGRTVAPGGARPDDGTGSPPDPLEPWSTKNIMNINKLLDQDTTEE

SEQ ID NO: 87 - protein, 1086 aa, Tribolium castaneum
MGAKVCKPCKKRKANTFQGGSILDRVISQASNQDQCLLYKLANYKKGGELIDAYNQGGQAEVEKLIREQFGQLMYQEGKGQIINRSEYLRWKFRDHEQVILPIEASLSRYDPLAKWNDHEACWQMQFRGSLGESLLHVLIICDTKIHTRLARTLIKCFPKLALDVVEGEEYLGASALHLAIAYNNNELVQDLVEAGANVNQRAIGSFFLPRDQQRQKPAKHTDYEGLAYLGEYPLAWAACCANESVYNLLLDSGAHPDYQDNFGNMILHMVVVCDKLDMFGYALRHPKLPASNGIVNKAGLTPLTLACKLGRAEVFREMLELSAKEFWRYSNITCSAYFLNALDTLLPDGRTNWNSALFIILNGTKEEHLAMLDGGIIQRLLEEKWKTFARNQFLKRLLILVVHLLFLSLAVYLRPDDPDESLLTWSDDVTLIARYVCEVGTILGVLSYLVLQQGDEIRNQGLTAFLKQQLNSPPKLIFLISNFLILACIPCRLYGDKETEEAILCFAVPGSWFLLMFFAGAVRLTGPFVTMIYSMITGDMLTFGIIYTVFLFGFSQSFYFLYKGFPGVKTSLYNTYMSTWMALFQITLGNYEYSELSATTYPAVSKTVFAIFMVFVPILLLNMLIAMMGNTYAHVIEQSEKEWVKQWAKIVIALERAIPQSDAQHYLQEYSISLGPSEQDPSTEKRGVLVIKSKSKTRAKQRKGAVANWKRVGKVTINALKKRGLTGEEMRCLMWGRESINTPVKTKKPVKDPLLDPQGPNLTGGFGDALTTALDVMTFTHDLDIVGASQGLNLATNPKPVPPTTTASAVTVNNQINSALNAQQKAVAGAGVGALAMIGTVTQLTDSQGYIMQNSVKKEEKIVATLEDPFRELVINANDSNCDPEKLKMLALSAANLKDVEELSVAKPQTKSVKSLAGIFAGTETFVRKVEETIKKKYAALDPSDSEGFGEPPLLGKISRTRRAKSANLRNSSARSKASDKKKLVAGSQSSSTDTVNNEINEKNIENSDLDYAEERIKLVKESLKQVVDVAQIRPINIDVALEEQVSVTISETMRVQGSGDGAEVQSSNVKPKRKKRSKTAKNNK

SEQ ID NO: 88 - protein, 1101 aa, Megachile rotundata
MGGVCSCRGLGSQVNAGSILDRVISQASDEDQCLLYRLANYKKSGELIDAYNQGGQAEVEKLIREQFGVLMYADGKGQMINRAEYLRWKFRDLEQVVLPIEASLSRFDPLAQWNDHQACWQMQYRGSLGETLLHVLIICDTRLHTRLARILLKCFPRLAIDVVEGEEYLGASALHLAIAYNNNELVQDLVEVGAIISQRAIGSFFLPRDQQRMNPAKNTDYEGLAYLGEYPLAWAACCANESVYNLLLDSGADPDEQDSFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLNMLDGGIIQRLLEEKWKTFARLQFLKRLIILVFHLTSLSLAVYLRPSNLDTVLLKWPEEVTEVGRTIAECITVLGVLSYILVQLGGEIINIGVLSFLKQLSHEPAKLIFLISNLLILACIPCRLAGNRHAEDAILVVAVPGSWFLLMFFAGAIRLTGPFVTMVYSMITGDMLTFGIIYMVVLFGFCQSFYFLYKGFPGVKSSLYSSYHSTWMALFQVTLGDYNYTDLSYTTYPNLSKMVFTIFMVLVPILLLNMLIAMMGNTYAHVIEQSEKEWVKQWAKIVVSLERAVSQKDAQNYLQEYSIKLGPGDDPNNPASEQRGVLVIKSKSKTKAKQRKGAVANWKRVGKVTINELRKRGMTGEELRRIMWGRASFSTPVRVSPNVDEPQVSAVTAGFGDALTAALDVMAFAHDLDLSTATESIPTNIDVKQSKPKVVSSEQTKLTTNNQEKPSITEKAATEIANKQVNAKDETNKKPNEVVDVEKMNVKNANNSSTVEEYHDLFLEFVIASESMNDPETLLKMAERVAAEFDSSANPKINLQILEQFTMTKIPMEEQAAAVKKQYFIESSDNDFGGDNLLGTVARLRRIRSANSRFITARRHSRHVNDDMSSTSSASGDGNPRYQQLLNDTEEVPSNQRTENRDESIVANKSEVKQNDANCGSRCKAQKRRPKTARNRVSPKETEDSGQRRRESMERNKAVSPATSPTDPLEPWSTRGIKDMNTILAWEENVPDSP

SEQ ID NO: 89 - protein, 1101 aa, Apis mellifera
MGGVCSFRGRGSQVNAGSILDRVISQASDEDQCLLYRLANYKKGGELIESYNQGGQFEVEKLIREQFGVLMYADGKGQVINRAEYLRWKFRDLEQVVLPIEASLSQFDPLAQWNDHEACWQMQYRGSLGETLLHVLIICDTRIHTRVARILLKCFPRLAIDVVEGEEYLGASALHLAIAYNNNELVQDLVEAGAIISQRAIGSFFLPRDQQRTNPAKNTDYEGLAYLGEYPLAWAACCANESVYNLLLDSGADPDEQDSFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILAFHLTSLSLAVYLRPSNTDAQLLKWPEEITEVARTIAECITVLGVLSYILVQLGGEIINIGLLSFMKQLSHEPAKLIFLISNLLILACIPCRLAGNRHAEDAILIVAVPGSWFLLMFFAGAVRLTGPFVTMVYSMITGDMLTFGIIYMVVLFGFCQSFYFLYKGFPGVKSSLYSSYHSTWMALFQITLGDYNYTDLSYTTYPNLSKMVFAIFMVLVPILLLNMLIAMMGNTYAHVIEQSEKEWVKQWAKIVVSLERAVSQKDAQNYLQEYSIKLGPGDDPNNPAAEQRGVLIIKSKSKTKAKQRKGAVANWKRVGKVTINELKKRGLTGEELRRIMWGRASFSTPVRVSPKGVEPQVSVVTAGFGDALTTALDVMTFAHDLDLSTATEGIPTNIDAKQSKPKSATKETKSTVNNQQNVTTNIEPLKSTTENVDDQANNPREKKVTSQAATVHEMNLKNANHSSVTEDFQDPLLELVIASENTNDPETLLEIAKRAAAGFETETSSKINLQILEQFTMTKIPMDEKVNVTRKQYFVESSDNDFGGDNLLGTEARLRRIRSANNRFITTRRRSRNVDDDLSSTSSTSMDRNPRYQSLLNGHENSIDRPIESRECSIEAINSQIKQNGPCETMKAKVQKKRPKTARNRVSPKEIEKAGPRRRESIERNKAVSPATSPTDPLEPWSTRGIKDMNTILAWEETAPDSP

SEQ ID NO: 90 - protein, 1105 aa, Apis florea
MGGVCSFRGRGSQVNSGSILDRVISQASDEDQCLLYRLANYKKGGELIESYNQGGQFEVEKLIREQFGVLMYANGKGQVINRAEYLRWKFRDLEQVVLPIEASLSQFDPLAQWNDHEACWQMQYRGSLGETLLHVLIICDTRIHTRVARILLKCFPRLAIDVVEGEEYLGASALHLAIAYNNNELVQDLVEAGAIISQRAIGSFFLPRDQQRMNPAKNTDYEGLAYLGEYPLAWAACCANESVYNLLLDSGADPDEQDSFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILAFHLTSLSLAVYLRPSNTDAQLLKWPEEITEVARTIAECITVLGVLSYILVQLGGEIINIGLLSFMKQLSHEPAKLIFLISNLLILACIPCRLAGNRHAEDAILIVAVPGSWFLLMFFAGAVRLTGPFVTMVYSMITGDMLTFGIIYMVVLFGFCQSFYFLYKGFPGVKSSLYSSYHSTWMALFQITLGDYNYTDLSYTTYPNLSKMVFAIFMVLVPILLLNMLIAMMGNTYAHVIEQSEKEWVKQWAKIVVSLERAVSQKDAQNYLQEYSIKLGPGDDPNNPASEQRGVLIIKSKSKTKAKQRKGAVANWKRVGKVTINELKKRGLTGEELRRIMWGRASFSTPVRVSPKGVEPQVSVVTAGFGDALTTALDVMAFAHDLDLSTATEGIPTNIDAKQSKPKSAIKEQMKLTTNNQENVSTNVEPQLKSTTENANDQANNPREIKKVTNQVTGIHEMNLKNANHSSVTEDFQDPLLELVIASENTNDPETLLEIAKRAAAGFETEASSKINLQILEQFTMTKIPMEEKVSVTRKQYFVESSDNDFGGDNLLGTEARLRRIRSANNRFITTRRRSRNVDDDLSSTSSTSMDRNPRYQSLFNGHENSIDRPIESRECSMEAINSQIKQNGPPCETVKAKVQKKRPKTAKNRVSPKEIEKAGPRRRESIERNKAVSPATSPTDPLEPWSTRGIKDMNTILAWEETAPDSP

SEQ ID NO: 91 - protein, 1055 aa, Pediculus humanus
  source: /note="Pediculus humanus corporis"
MGAGLCGTSQDPQNQGSVLDRVISQASNKDDCLLYKLANYKNSGELIEAYNIGGQAEVEKLIKEQFGVLMYADGKGEVIKRAEYLRWKFRDQAQVVLPIEASLSIYDPLAKWEDHEACWQMQYRGSLGETLLHVLIICDSKIHTKLARTLLKCFPKLALDIVEGEEYLGASALHLAIAYNNNELVEDLVDAGANINQRAVGSFFLPKDQQRAKPLKTTDYEGLAYLGEYPLSWAACCSNESVYNLLLDVGADPDSQDSFGNMILHMVVVCDKLDMFGYALRHPKVPASNGIINNEGLTPLTLACKLGRADVFKEMLELSAKEFWRYSNITCSAYPLNALDTLLPDGRTNWNSAIFIILNGTKEEHLDMLDGGIIQRLLEEKWKTFARNQFLKRLVIFFLHIFCLSGSVYLRPDDRNKPLLGGTSVQDVVRYCFEIGTILGVLCYLCFQQGDEIRNQGLISFLKQLPHDPAKFIFLISNLLILACIPYRVAGDTDTEEAILVFAVPSSWFLLMFFAGAIRLTGPFVTMIYSMITGDMLTFGIIYSVFLFGFSQSFFFLYKGSKNVSSSLFTSYPSTWMALFQVTMGDYNYNDLSLTAYPAISKMVFTIFMVLVPILLLNMLIAMMGNTYAHVIEQSEKEWMKQWAKIVVALERAVNQEDCHRYLQEYSIKLGPGDDPSTEQRGVLVIKSKSKTRAKQRKGALCNWKRVGKVTIRELHKRGMTGEQLRRLMWGRSSISTPVKPAPIKLGHVTSISGVADITVPETTGNTVGTGGGGLLAALDVMAFTNDLEFSSENQTSTSFKTQPQPSEVSCVESDSNSDPLYNDPLRQLNEELNKTREEILTLARVAANNDGIEEIPPQICQYGWINNYNFFGNTFAQNQKVEDPVQQPTFQSTPNHSDSDGLGDGLLLGSNRRLKRTRSANIKRKFSGSSTNEKNLLEPEDSSSTNSEDFSCLTENYINKNIKVNANFSENSLRSNRSSANLVVKKFGRRSGLKSSTNRIAPADLSPVGNVSKYSETLCNSYCITSSSDVLYQWSIKGITNMNTLLGLENEDSM

SEQ ID NO: 92 - protein, 1109 aa, Acromyrmex echinatior
MGGVCSCRVGRNSQVNAGSILDRVISQASNEDQCLLYRLANYKKGGELIEAYNQGGQPEVEKLIREQFGILMYMDGKGQIINRAEYLRWKFRDLEQVVLPIEASLSRFDPLAQWNDHEACWQMQYRGSLGETLLHVLIICDTRMHTRIARILLKCFPRLAIDVVEGEEYLGASALHLAIAYANNELVQDLVEAGAIISQRAIGSFFLPRDQQRMNPARNTDYEGLAYLGEYPLAWAACCANESVYNLLLDSGADPDEQDTFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILVFHLASLSLAMYFRPADMEAVLLQWPEEITDVVRTAAECITVLGVLNYILVQLGCEMINVGPLSFLKQLSHEPAKLIFVISNLLILACIPCRIAGDRHAEDAILMFAVPGSWFLLMFFAGAIRLTGPFVTMVYSMITGDMLTFGIIYTVMLFGFSQSFYFLYKGFPGVKSSLYHSYPSTWMALFQITLGDYNYADLSNTTYPNLSKTVFAIFMVLVPILLLNMLIAMMGNTYAHVIEQSEKEFVKQWAKIVVSLERAVSQKDAHNYLQEYSIKLGPGDDPNNPASEQRGVLVIKSKSKTRAKQRKGAVSNWKRVGKVTILELRKRGMTGEELRRIMWGRASFSTPVRVSPNAGQPQVSAVTAGFDDALTAALDVMAFAHDFDLSTATEGIPTNIDAKQIKTAQSKAALNDQQTKTTQNNPEVVINVQPHNQPIKEETKLSGLTDLIDKSIDPVKDVEAMNLRNMNQTKALEETVEDPFLELAIASETTTDYKTLLQIAKSALATSEASMKTTIDPQILAHFAMVAPPTIEKSSIVKKQYFMESSDNDLGGDNLLGTEARLRRIKSANNRFTTSKRSRRDDDGDSSSSTTSVEQSLRYRPLLNDPEQRPMNRIETEGRKTTVETIKPEVKQNGSIPTKPLDKIQKRRPKTAKNRVSPKETEEPARRRESIERNKAASPPTSSSDPLEPWSTRGITDMNTILAWRENAPDSP

SEQ ID NO: 93 - protein, 1112 aa, Harpegnathos saltator
MGGVCSCRGRGSQVNAGSILDRVISQASNEDQCLLYRLANYKKGGELIEAYNQGGQPEVERLIREQFGILMYADGKGQVINRAEYLRWKFRDLEQVVLPIEASLSRFDPLAQWYDHEACWQMQYRGSLGESLLHVLIICDTRMHTRIARTLLKCFPRLAIDVVEGEEYLGASALHLAIAYNNNELVQDLVEAGAIISQRAIGSFFLPRDQQRMNPVRNTDYEGLAYLGEYPLAWAACCANESVYNLLLDSGADPDEQDSFGNMILHMVVVCDKLDMFGYALRHPKLPTRNGIVNAAGLTPLTLACQLGRAEVFREMLELSAREFWRYSNITCSAYPLNALDTLLPDGRTNWNSALFIILNGTKEEHLDMLDGGVIQRLLEEKWKTFARLQFLKRLIILVFHLASLSLAVYFRPADMDAELLQWPDEITDAARIAAECSTVLGVLSYILVQLGGEMINIGPLSFLKQLSHEPAKLIFVISNLLILACIPCRIAGNRHAEDAILVFAVPGSWFLLMFFAGAIRLTGPFVTMVYSMITGDMLTFGIIYTVMLFGFSQSFYFLYKGFPGVKSSLYHSYPSTWMALFQITLGDYNYADLSNTTYPNLSKTVFAIFMVLVPILLLNMLIAMMGNTYAHVIEQSEKEFVKQWAKIVVSLERAVSQKDAHNYLQEYSIKLGPGDDPNNPASEQRGVLIIKSKSKTRAKQRKGAVANWKRVGKVTINELRKRGMTGEELRRIMWDRASISTPVRVSPNVNEPQVSAVTAGFGDALTAALDVMAFAHDFDLSTATEGVPSNIDTRQTKAIPDEQTRTARNNPKAVTDVQPHKQAIGGEETKLSGLTDLIDMSAAEPARVEAMNLKNASQAKAHEGAVEDPFLELAIASETTEDYDTLLQMAKSALATSEASTTVDPQILAHFTMIAPPPVEKPIVVKKQYLVESSDNDLGGDNLLGTEARIRRIKSANDRFISTSKRSHHDDDNDSSSSVTSVDRSQPQYRPLLNDSEESLANRVENEGRRTSDVETIKSEVKQNGRGGGGGGVSKPSDKRVQKRRPKTAKNRVSPKEIEEPARRREESIERNKAALSPPASPSDPLEPWSTRGITDMNTILAWRENAPDSP

SEQ ID NO: 94 - protein, 1104 aa, Bombus impatiens
MGGVCSCRGRGSQVNAGSILDRVISHASDEDQCLLYRLANYKKGGELIESYNQGGQAEVEKLIREQFGVLMYADGKGQAINRAEYLRWKFRDLEQVVLPIEASLSQFDPLAQWNDHEACWQMQYRGSLGETLLHVLIICDTRIHTRLARILLKCFPRLAIDVVEGEEYLGASALHLAIAYNNNELVQDLVEAGAIISQRAIGSFFLPRDQQRTNPAKNTDYEGLAYLGEYPLAWAACCANESVYNLLLDSGADPDEQDSFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILVFHLTSLSLAVYMRPSNIDATLLEWPEEITEVGRMIAECTTVIGVLSYILVQLGGEVVNIGLLSFMKQLSHEPAKLIFLISNLLILACIPCRLAGNRHAEDAILVVAVPGSWFLLMFFAGAIRLTGPFVTMVYSMITGDMLTFGIIYMVVLFGFCQSFYFLYKGFPGVKSSLYSSYHSTWMALFQITLGDYNYTDLGYTTYPNLSKMVFAIFMVLVPILLLNMLIAMMGNTYAHVIEQSEKEWVKQWAKIVVSLERAVAQKDAQNYLQEYSIKLGPGDDPNNPASEQRGVLIIKSKSKTKAKQRKGAVANWKRVGKVTINELKKRGITGEALRRVMWGRASFSTPVRTSPNTAEPQVSAVTAGFGDALTAALDVMAFAHDLDLSTATEGIPTNIGAKQSKSKTACKDQAKSATNNQEKGSTDVQQQRKLTTENLDNLASSHNDIDKTSSEFVAVREMNSKNASHSSMAEDFQDPLLELVIASENTDDPETLLKIAERAAANFEVESSSKINLQILEQFTMTKLPMEEKVAATKKQYFVESSDNDFGGDNLLGTEARLRRIRSANNRFITTRRRSRHTDDDLSSTSSTSADRNPQYQPLLNGPENLASRQIESRESSIEAIKPQVKQNGSCDSVKIKVQKRRPKTAKNRVSPKEIEEAGPRRRESIERNKAVSPATSPTDPLEPWSTRGIKDMNTILAWEENTPDSP

SEQ ID NO: 95 - protein, 1024 aa, Bombus terrestris
MGGVCSCRGRGSQVNAGSILDRVISHASDEDQCLLYRLANYKKGGELIESYNQGGQAEVEKLIREQFGVLMYADGKGQAINRAEYLRWKFRDLEQVVLPIEASLSQFDPLAQWNDHEACWQMQYRGSLGETLLHVLIICDTRIHTRLARILLKCFPRLAIDVVEGEEYLGASALHLAIAYNNNELVQDLVEAGAIISQRAIGSFFLPRDQQRTNPAKNTDYEGLAYLGEYPLAWAACCANESVYNLLLDSGADPDEQDSFGNMILHMVVVCDKLDMFGYALRHPKLPARNGIVNAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILVFHLTSLSLAVYMRPSNIDATLLEWPEEITEVGRMIAECTTVIGVLSYILVQLGGEVVNIGLLSFMKQLSHEPAKLIFLISNLLILACIPCRLAGNRHAEDAILVVAVPGSWFLLMFFAGAIRLTGPFVTMVYSMITGDMLTFGIIYMVVLFGFCQSFYFLYKGFPGVKSSLYSSYHSTWMALFQITLGDYNYTDLGYTTYPNLSKMVFAIFMVLVPILLLNMLIAMMGNTYAHVIEQSEKEWVKQWAKIVVSLERAVAQKDAQNYLQEYSIKLGPGDDPNNPASEQRGVLVIKSKSKTKAKQRKGAVANWKRVGKVTINELKKRGITGEALRRVMWGRASFSTPRDTLRALGSVGIVRAVGTLGPVGTVRAVGALGPVGTVRDSSMAEDFQDPLLELVIASENTDDPETLLKIAERAAANFEVESSSKINLQILEQFTMTKLPMEEKVAATKKQYFVESSDNDFGGDNLLGTEARLRRIRSANNRFITTRRRSRHTDDDLSSTSSTSADRNPQYQPLLNGPENLVSRQIESRESSIEAIKPQVKQNGSCDSVKIKVQKRRPKTAKNRVSPKEIEEAGPRRRESIERNKAVSPATSPTDPLEPWSTRGIKDMNTILAWEENTPDSP

SEQ ID NO: 96 - protein, 949 aa, Dendroctonus ponderosae
MGGCQCKPCCKHKKSHYTGGSILDRVISQSSNQDQCLLYRLANYKKGGELIDAYNAGGQIECEKLIRDQFAQLMYQDGKGKIINRSEYLRWKFRDHEHVILPIEASLSRYDPLGKWTDHEACWQMQYRGSLGESLLHLLIICDSKIHTRLARTLIKCFPKLALDVVEGEEYLGASALHLAIAYSNNELVQDLVEAGANVNQRAIGKQIADKTGKINAKNRSFFLPRDQQKQRPAKHTDYEGLAYLGEYPLAWAACCANESVYNLLLDSGAHPDLQDNFGNMILHMVVVCDKLDMFGYALRHPKLPASNGIINKAGLTPLTLACKLGRAEVFREMLELSCKEFWRYSNITCSAYTLNALDTLLPDGRTNWNSALFIILNGTKEAHLDMLDGGIIQRLLEEKWKAFARNQFLKRLIILIVHLAFMSLAVYMRPDDPDEPLLEWSDDPTVIIRFTAEIGTLLNVLSYVVVQQGDEIRNQGFLSFLKQQTNSPPKCIFLVSNLMILACIPCRLAGNRGLEETILIFAVPGSWFLLMFFAGAVRLTGPFVTMIYSMITGDMLTFGIIYTIFLFGFSQSLFFLYKGNPSVNGTLYHSYSSTWMALFQVTMGNYDYSELALTTYPGVAKSVFGLFMVFVPILLFNMLIAMMGNTYAHVTEQSEKEWVKQWAKIVISLERAIPQKEAHNYLQEYSISLGPAEDPATEQRGVMVIKSKNKTRAKQRKGAVSNWKRVGKVTIKALKKKGMTGEEMRCLMWGRESINTPVKVKGPKRDPLANPQGPDLANGFGDALTSALDVMAFTHDLDINAQGLNLAKQTLNPKPFTDPLRTLVLESLVETNSARLSVLAAQAANLPDTAEIVSCPNTATTSVKNLAGIFAGTGNFVKKIEEKVKKKKYAVLECSDSESFGGKCHGISTHFQSKTLKYCRSAAGDNITGEEGQTDTYATFCKQEKEFR

SEQ ID NO: 97 - protein, 1147 aa, Nasonia vitripennis
  MOD_RES (351)..(351): Any amino acid
MGGACSCQGRDSQVNAGSILDRVISQASDEDQCLLYRLANYKKGGELIEAYNQGGQAEVERLIREQFGILMYADGKGQTINRAEYLRWKFRDLDQVILPIEASLSRFDPLAQWSDHEACWQMQYRGSLGETLLHVLIICDTRTHTRIARTLLKCFPRLAIDVVEGEEYLGASALHLAIAYANNELVQDLVEAGAIVSQRAIGSFFLPRDQQRPRPAKSTDYEGLAYLGEYPLAWAACCANESVYNLLLDSGAHPDEQDTFGNSILHMVVVCDKLVRFGYALRHPKLPASNGIANAAGLTPLTLACQLGRAEVFREMLELSAREFWRYSNITCSAYPLNALDTLLPDGRTSXNSALFIILNGTKEEHLDMLDGGIIQRLLEEKWKTFARLQFLKRLVILVFHLVSLSLAVYFRPADTDAELAQWPEEITDVVRVIAECVTVLGVLGYILLQLGGEIVNIGFFSFFKQLSHEPAKFIFLISNLLILACIPCRLSGDRHTEDAILVVAVPGSWFLLMFFAGAVRLTGPFVTMVYSMILGDMRTFGIIYMIVICGFTQAFYFLYKGYPGVKTTLFHSYPSTWMALFQITLGDYSYSDLSMTTYPNLSKAVFTIFMVLVPILLLNMLIAMMGNTYAHVIEQSEKEWMKQWAKIVVSLERAVSQDDAHNYLQEYSIKLGPGDDPNDPASEQRGVMVIKSKSKTRARQRKGAVANWKRVGKVTIAELKKRGMTGEELRRIMWGRASFSTPVRSSPILMEPVSSVPGGFGDALTSALDVMTFAADVPVPIEGSIPKPVAVAPGQQPTTTLALPNGAAKPQQPMMTTSTTTTTITTTVQKTLVTGTATTPAVGVTKTVAVPAATTVSTTTTRASASAVPPTVRPSELGPASAPCSADPLLELMLATEDPGSSEETLQRLAHSARIVGESATTSAKSDIDSSFLERLALGGLGLAAMPEQPDKPVEPKKKQYLVESSDNDICANDGQLGTEARLRRIRSASSRLAPTTTTSTSRRKSGQQKQQREARDDESTSSAASLDNISGYQPLLNEPDTTADQPATGTEDNKPANGRNLRKRPKTTSNEGKVFCSRRTIVVLNKNKKNKKLETSEANMNARKKETLLALHDMTSLISGRVLTLEQANENGYEMLEQLKHKLDP

SEQ ID NO: 98 - protein, 1109 aa, Camponotus floridanus
MGGVCSCRVGRGNQLNAGSILDRVISQASNEDQCLLYRLANYKKGGELIEAYNQGGQPEVEKLVREQFGILMYADGKGQVINRAEYLRWKFRDLEQVVLPIEASLSRFDPLAQWNDHEACWQMQYRGSLGEALLHVLIICDTRIHTRIARILLKCFPRLAIDVVEGEEYLGASALHLAIAYNNNELVQDLVDAGAIISQRAIGSFFLPRDQQGMNPVRNTDYEGLAYLGEYPLAWAACCANESVYNLLLDSGADPDEQDSFGNMILHMVVVGDKLDMFGYALRHPKLPARNGIANAAGLTPLTLACQLGRAEVFREMLELSAREFWRYSNITCSAYPLNALDTLLPDGRTNWNSALFIILNGTKEEHLDMLDGGIIQRLLEEKWKTFARLQFLKRLIILVFHLASLSLAVYFRPADTDAVLLQWPEEITDVIRTAAECITVLGVLNYILVQLGGEMINVGPLSFLKQLSHEPAKLIFVISNLLILACIPCRIAGNRHAEDAILVFAVPGSWFLLMFFAGAIRLTGPFVTMVYSMITGDMLTFGIIYTIMLFGFSQSFYFLYKGFPGVKSSLYHSYVSTWMALFQITLGDYNYAELNNTIYPNLSKTVFAIFMVLVPILLLNMLIAMMGNTYAHVIEQSEKEFVKQWAKIVVSLERAVSQKDAHNYLQEYSIKLGPGDDPNNPASEQRGVLVIKSKSKTKAKQRKGAVANWKRVGKVTINELRKRGMTGEELRHIMWGRESFSTPVRVSPNAGQPQVSAVTAGFGDALTAALDVMAFAHDFDLSAATEGIPTNIDAKQTKTTQSKAIPNDQMKTTQNNPETVTNVQPHKQPIGEPTKLLGLTDLIDNSIGPVKDVEAMNLKNTNQTKALEASMEFEDPFLELAIASETTTNYEILLQIAKSALAASEASVKTAIDPQILAHFAMIPPPITEKFIVKKQYFMESSDNDVGGDNLLGTEARLRRIKSANNRFITTSKRPHRDDDGDSSSSTISIERNQRYRPLFNDPEERSINHVETEGQKTPMETIKSEIQQNGSIPLKPPDKIQKRRPKTAKNRVSPKEIEEPRRRESIEQNKAASPPTSSSDPLEPWSTRGITDMNTILAWRDNAPDSP

SEQ ID NO: 99 - protein, 998 aa, Danaus plexippus
MGVPLSKLCSATSVPAVGSVLDRVISQPSSEDHTVLYKLADYKKGGLLLETYTKGGVVAAERLIREEFSAYMYAGGRGRVINRAEYLRWKFRDQEQVVLPIEASLSPHDPLAKWEDHTACWQMSYRGALGESLLHVLIICDTKIHTRLARTLVKCFPKLSLDVVEGEEYLGASSLHLAIAYSNNELVQDLVEAGADVSQKAIGSFFLPRDQQKNPPARQTNYEGLAYLGEYPLAWAACCANEAVYNLLLDSGADPDAQDSFGNMILHMVVVCDKLDMFGYALRHPKVPASNGRLNKAGFTPLTLACQLGRASVFREMLELSSREFWRYSNITCSAYPLNALDTLLPDGRTNWNSALFIILNGTKQEHLNMLDGGIIQRLLEEKWKTFARTKFLKRLLILMLHLILLSISVYLRHSSLEADVDPDWGLEVNDARSGIRLACELGTIISTLCYIILQQGDEIKNQGVVAYFKQLIHEPAKFIFLASNILLLACIPARISQRTTLEEAILIFVLPGSWFLMMFFAGAVKLTGPFVTMIYSMITGDMFTFGIIYCIVLFGFSQSFYFLYKGFPNVHSTLYSSYPSTWMALFQITLGDYSYTDLGLTMYPNLSKTVFTVFMVFVPILLLNMLIAMMGNTYAHVIEQSEKEWVKQWAKIVVSLERSVSQEDAHRYLQEYSIGLGPSDDPRYEQRGVMVIKSKAKTRAKQRKGALSNWKRVGKVTIAELRRRGISGEELRRLMWGRVSISTPTKAPLKCVPPPELVTSEIPGSGVGPALSSALNVMAYTQDLDLTNTGSELHKQITPDLLVNGKTPVTAQNTATTPKVPLVNLPNKAGLDVQSTGSDQSVPTALTKNMDVLGINMSTQDLLKNQTINNPATANEIVFKDYLRDIIKAEQLGLDNIDIKALAEKAANLTDVPEIDINISTAARSARRVVAGAVSGLFGVTAETPRDAGWRRERHEHTDSDPVPECVILGRAARARRARSASRRAPPPPPHLYVPAR

SEQ ID NO: 100 - protein, 1179 aa, Bombyx mori
MGNAIGKFLTAGNVQGAGSVLDRVISQPSSEDHTVLYKLADYKKGGLLLETYAKGGMTAAEKLMRDEFAAYMYGGGRGRVINRAEYLRWKFRDQEQVVLPIEASLSPYDPLAKWEDHTACWQMCYRGALGESLLHVLIICDTKIHTRLARTLVKCFPKLSLDVVEGEEYLGASSLHLAIAYSNNELVQDLVEAGADVNQRAIGSFFLPRDQQRVPPARQTNYEGLAYLGEYPLAWTACCANEAVYNLLLDSGADPDAQDSFGNMILHMVVVCDKLDMFGYALRHPKVPASNGRMNKAGFTPLTLACQLGRASVFREMLELSAREFWRYSNITCSAYPLNALDTLLPDGRTNWNSALFIILNGTKQEHLNMLDGGIIQRLLEEKWKTFARTKFLKRLLILMLHLLLLSVSVYLRHSSAEADAHPNWGLEINDARSGLRLASELGTILSTLCYIILQQGDELKNQGLVAYFKQLIHEPAKFIFLASNILVLACIPARLLKETNVEEAILLFLLPGSWFLLMFFAGAVKLTGPFVTMIYSMITGDMFTFGIIYCIVLFGFSQSFYFLYRGFPNVQSTLYSSYPSTWMALFQITLGDYSYSDLSQTTYPNLSKTVFTVFMIFVPILLLNMLIAMMGNTYAHVIEQSEKEWVKQWAKIVVSLERSVAQDDAHKYLQEYSIGLGPSDDPRYEQRAVMVIKSKAKTRAKQKKDALTNWKHVGKVTIAELRRRGISGEELRRLMWGRISISTPTKAPLPRRVPAPPPDCVVSSDVGLASDVGNGVAPALSSALNVMAFTHELDIGTTGSDQKQTTPDLLVNGKTSNAPILTTGTQMPKVSSKTLGTPVARIEASSLKTPLDVKLNPTTLTQSTVQGNIGNVNIPISGVKITTNVGQNSAVVPEIQQSNENQKPEQVHQDYLRELIVLAEKPATTNLELKQLAEKAADLRDVPEIDININMAAKSARKMVAGAVSGLFGVAADTPAPDAGWRRDRHDNSDSDPISESVLLSRASRARRARSASRRAAPPPPHLYVPARSMYLVASESSAIESDAPWDDQPSSENNSAVGGRREEIAHIKAARPLCIQHAASGRTAQVEHSLFVVGPGTGAEVESTPTVQKSEKKARPKTTRSRRNRISPTPVQEAGSPLEPWATAQLSKLSRLIRYSSSSAASITSQTSTEQEQSPRY

SEQ ID NO: 101 - protein, 993 aa, Acyrthosiphon pisum
MGNSCASCTDFSFSKTASGSVLDRVISQASNEDDCLLYKLADYKKGGELINVYNNGGQDEAERFIVEKLPGLMYNNGKGQVINRNDYLRWKFQNRKHVAVNVEERPGPHDPLTRWVDHVACWQMQYRGSLGESLLHVLIICDTVIHTRLSRLLLKHYPMLSQDVVEGEEYLGASALHLSIAYNNNDLIQDLVDAGANICQRAIGSFFLPRDQQNKEINNKHTDYEGLAYLGELPLAWAACCGNQTVYNLLIDAGANPDAQDSFGNMILHMVVVCDKLSMFGYALKHPKVKASNGIMNVAGLTPLTLSCKLARTSVFREMLELSAREFWRYSNITCSAYPLSALDTLLPDGRTNWNSVLFIILDGTKEEHLDMLDGGIIQKLLEEKWKTFARKQFMKRLVILSIHLIMLSISIYLRPVDQDKPLLGEAEDWQDVARYCFEGGTVVGVLSYLIVQQGGEILNQGLVGFLKQTFKEPAKLIFLISNLLILACIPPRMMGDKQTEEAILVFAVPGSWFLLMFFAGAIRLTGPFVTMVYLMITGDMLTFFVIYSVILSGFTQSFFFLYKGSPDVSTSLYKSYPSTWMALFQITMGDYNYADLSYTVYPALSKTVFTVFMVLVPILLLNMLIAMMGNTYAHVIEQSEKEWMKQWAKIVVTLERAVPQKAARNYLEEYSIQLAPGDDVNPEQRGFMVIKCKSQTRAKQRKGAVINWKKSGKLVIQELRRLEGTGQNLRDMIWKRSSLSASSPVAKSVSITKNKSKSYSEAKDDQIRLSGALGAALDAIAVAHDLDMTLTKDQSIDELHDPLRQLVIMSESDKNIDKSQVEIVANAAAKIANQDSIKPISINLEQQNDVKNEKTKIPTSSNTITNRKLLNKQSKNLSMYGFESQDMSVDKYSKAIAITRSISTQTGGIGIIEKNERQIIRPKTAKINRVTPTQNFAVKRGQSAQPDKREDHRDNKEQQCYCISGNNMLRPWSTQDLAPLNTIMAWGPNDDF

SEQ ID NO: 102 - protein, 275 aa, Solenopsis invicta
MGGACSCRFGRGSQVNPGSILDRVISQASNEDQCLLYRLANYKKGGELIEAYNQGGQPEVEKLIREQFGILMYADGKGQTINRAEYLRWKFRDLEQVVLPIEASLTRFDPLAQWNDHEACWQMQYRGSLGETLLHVLIICDTRMHTRIARILLKCFPRLSIDVVEGEEYLGASALHLAIAYNNNELVQDLVEAGAIISQRAIGSFFLPRDQQRMNPARNTDYEGLAYLGEYPLAWAACCANESVYNLLLDSGADPDEQDSFGNMILHMVVVGDKL

SEQ ID NO: 103 - protein, 142 aa, Schistocerca americana
  MOD_RES (12)..(12): Any amino acid
SWFLLMFFAGAXRLTGPFVTMVYSMITGDMLTFGIIYTVVLFGFSQSFYFLYKGFPGVKTSLYHSYPTTWMALFQITMGDYNYPELSHTTYPTLAKTVFAIFMVLVPILLLNMLIAMMGNTYAHVIEQSEKEWMKQWAKIVV

SEQ ID NO: 104 - protein, 889 aa, Myzus persicae
  MOD_RES (289)..(296): Any amino acid
  MOD_RES (371)..(436): Any amino acid
  MOD_RES (745)..(759): Any amino acid
ERPGPHDPLTRWVDHVACWQMQYRGSLGESLLHVLIICDTVIHTRLSRLLLKHYPMLSQDVVEGEEYLGASALHLSIAYNNNDLIQDLVDAGANICQRAIGSFFLPRDQQNKEINNKHTDYEGLAYLGELPLAWAACCGNQTVYNLLIDAGANPDAQDSFGNMILHMVVVCDKLSMFGYALKHPKVPASNGIMNVAGLTPLTLSCKLARTSVFREMLELSAREFWRYSNITCSAYPLSALDTLLPDGRTNWNSVLFIILDGTKEEHLDMLDGGIIQKLLEEKWKTFARXXXXXXXXILSIHLIMLSISIYLRPVDQDKPLLGEAEDWQDVARYCFEGGTVVGVLSYLIVQQGGEILNQGLVGFLKQTFKEXXXXXXXXXXXXXXXXXXXXXXXXXXXXXXXXXXXXXXXXXXXXXXXXXXXXXXXXXXXXXXXXXXDMLTFFVIYSVILSGFTQSFFFLYKGSPDVSTSLYKSYPSTWMALFQITMGDYNYADLSYTVYPALSKTVFTVFMVLVPILLLNMLIAMMGNTYAHVIEQSEKEWMKQWAKIVVTLERAVPQKAARNYLEEYSIQLAPGDDVNPEQRGFMVIKCKSQTRAKQRKGAVINWKKSGKLVIQELRRLEGTGQNLRDMIWKRSSLSASSPVAKSVSITKNKSKSYSEAKDDQIRLSGALGAALDAIAVAHDLDMTLTKDQSIDELHDPLRQLVIMSESDKNIDKSQVEIVANAAAKIANQDSIKPISVNLEQXXXXXXXXXXXXXXXTITNRKLLNKQSKNLSMYGFESQDISVDKYSKEIVITRSISTQTGGIGIIEKNERPIIRPKTAKINRVTPTQNFAVKRGQSAQPDKREDHRDNKEQQCYCISGNNMLRPWSTQDLAPLNTIMAWGPNDDF

SEQ ID NO: 105 - protein, 967 aa, Bemisia tabaci
MYNDGKGQIIKRAEYLRWKFRDQQQVTLPIEASLSPHDPLAKWEDHEACWQMQYRGSLGETLLHVLIICDTKTNTRLARTLLKCFPRLAQDIVEGEEYLGASALHLAIAYNNNELVQDLVEAGANVNQRAIGSFFLPKDQQRPRPAKHTDYEGLAYLGEFPLSWAACCANESVYNLLLDSGAHPDMQDTFGNMILHMVVVCDKLDMFGYALRHPKLPASNGITNTAGLTPLTLACKLGRAEVFREMLELSAREFWRYSNITCSAYPLNALDTLLPDGRTNWNSALFIILNGTKEEHLDMLDGGIIQRLLEEKWKTFARRQFLKRLAILFLHLLMLSMAVYLRPVDREQPLIGGDDWSDIARYGFEVGTIMGVLSYLVVQQGGEIKNQGLGSFLKQLMAEPAKAIFLVSNLLILACIPFRMAGDSQTEEAILILAVPGSWFLLMFFAGAVRLTGPFVTMIYSMITGDMFTFGIIYSILLFGFSQSFYFLYKGSPNVKQTLFHSYPTTWMALFQITLGDYNYPELAFTVYPTLSKIVFTSFMVLVPILLLNMLIAMMGNTYAHVIERSEKEWMKQWAKIVVALERAVPAADAHNYLQEYSIKLGPGDDPSTEQRGVMVIKSKSKTRAKQRKGAVSNWKRVGKVTINELRKRGMTGEQLNRIMWGRASISTPVRQPAMALLLEDSEEENAANNTGPFGGALTAALDVMAFTHDIDLNIGQTPVTVSGLGGVSVRSGAEGLPPEQPFHDPFRQLVIEAENPHIDESELAALANAAAMSVVAPDDIPTPVVTPEPVSALPRLPSLHLEPSDSDGLGDGPLLGRGSRVRRVRSAHLKQQKASSTNGNGYSDRQRLFSSKNEDSSSNTSLDFDLTNPPSQLRLTPPPRPVTAEIVAVNPKKYIGGNSQERLRPKTAKVNRVAPTPDVPVRRGISANGIPESLPSPPDPLEPWSTRNIVNMNAILAWQQSDQDSL

SEQ ID NO: 106 - protein, 984 aa, Euschistus heros
  MOD_RES (383)..(383): Any amino acid
  MOD_RES (466)..(466): Any amino acid
  MOD_RES (649)..(649): Any amino acid
MGIIWGSGASSVNAGTVLDRVISQASNKDECLLYKLANYKKGGELIDAYNAGGQSEVEKLIREQFGQLMYNEGKGALINRAEYLRWKFRDMQQVQIPIEASLSSQDPLSKWEDHQACWQMQYRGSLGETLLHVLIICDTKIHTRLARTLLKCFPNLAIDVVEGEEYLGASALHLAIAYFNNELVQDLVEAGANVEQRAIGSFFLPRDQQGQRPSKHTDYEGLAYLGEYPLAWAACCANESIYNLLLDNGANPDHRDTFGNMILHMVVVCDKLDMFGYALRHPKMPASNGIANVAGLTPLTLACKLGRAKVFREMLELSAREFWRYSNITCSAYPLNALDTLLPDGRTNWNSALFIILNGTKEEHLDMLDGGIIQRLLEEKWKXFARRQFLKRLVILMLHLLCLSGAVYLRPTDRTKPLLGGDDWKSVARQGFEVATVLGVLSYVIVQQGGEIRNQGFISFIKQLDXAKAIFLVSNILILICIPFRLMDDKRTEEAILVFAVPGSWFLLMFFAGAVRLTGPFVTMVYSMIVGDMFTFGIIYSIVLFGFSQSFYFLYKGFPGVKNTLYSSYHSTWMALFQITLGDYNYAELSHTSYPTLSKTVFAIFMILVPILLLNMLIAMMGNTYAHVIEQSEKEWMKQWAKIVVSLEXAVNQEDCKQYLQEYSIKLGPGDDPSTEQRGVMVIKSKSKTRAKQRKGAVANWKRVGKVTINELRKRGMNGEQLRRIMWDRASISTPVKVPQNPVVDVLMENTAEQQAQQTPGSFGGALTAALDVMAFTHDLDLSASGITSSGLNAKELIVSDPFRDLVLSSEIDVGEEELATLAEAAVLSVMSGQSDESEKLKIAKFNKQISFEQNAVLEVSDSDGFLDGQPLGQGSRARKVKSAQERQRAERTWGGTSISSIEEPPPYLPLPPPPPLHSHQRPRPKTAKPNRVVPEAVVAKRPQSSALGDRVKSPPELLEPWSTRGIATINTILAWQPSDQDSM

SEQ ID NO: 107 - protein, 8 aa, Artificial Sequence
  source: /note="Description of Artificial Sequence: Synthetic peptide"
DYKDDDDK

SEQ ID NO: 108 - DNA, 18 bp, Artificial Sequence
  source: /note="Description of Artificial Sequence: Synthetic primer"
ggactttccaaaatgtcg

SEQ ID NO: 109 - DNA, 56 bp, Artificial Sequence
  source: /note="Description of Artificial Sequence: Synthetic primer"
ccggccgtttatcactacagaattcgaagcttaaccttatcgtcgtcatccttgta

SEQ ID NO: 110 - protein, 823 aa, Apis mellifera
MGNTESNVASGVKKQTDASSILLYKLVDLKGGGLLVDMMKRATQTKQYAELDHALRTKVEPYLYNKGKGKWIPIEKLVLLRNKDRPKHKMLPPLRAMENPADYDIDKDMGEDEVDETKIDKSKYRLVCWSLSERGAVGETILHLCMLHATAIHIDLAKRLLRFYPKLINDVYISDEYYGESALHIAIVNEDPSMVKFLLDSGADVHERCIGNFMCPEDQKASRADSLDHEWVCVTPETNYNGYVYWGEYPLNFAACLGQEECYRLILARGADPDKQDTNGNTVLHMLVIYEKLATFDMAYEVGASLAIRNAQHLTPLTLSAKLAKIEMFFHILNIEREIYWQIGSITCAAYPLSQVDTIDVDTGSISHNSALNLVVFGEKDEHLELMDGILVDLLNAKWNTFVKFRFYRQFFLFCFYFVLSLISFTLRPGPATTSSLDIVENLTSALSDMLGTYRNEIKLFNRSDKTSIYSSRNDAKPIDETIFFPSYFSKSLVSNVRWNNLTEECRLMHLDTLSTKIRLTAEVLMEIAATLYIFAALREARFLGLNMFIENLMTAPSRVMFLFSCCILLTFPFLRLICADEIEDMLAVVVMLTTAPYFLFFCRGFKTVGPFVVMIYRMIMGDLLRFVSIYLVFVMGFSQAYYIIFLSFDNPNTPEGVDDSMSNPMPSPIESIMAMFLMSMTNFGDYYGAFERTQHEMEAKFLFVVYMAIVAILLVNMLIAMMGNTYQKIAETRNEWQRQWARIVLVVERGVSPDERLKKLMDYSQPMSDGRRALVLRLNQSEEDKEEMKEILEMKRTHDKLYKRRQSKTMKKILTSEDNVIL

SEQ ID NO: 111 - protein, 832 aa, Nasonia vitripennis
MGNAESNVTSGVKKQTDAGAIALYKLVDLKGGGLLVDMMKRASQTKQYAEIDHAIRTKVEPFLYNGGKGKWIPIAKLVLLRNKERGRHKMLPVLKAMEKPEDYDIDKDMANDPEPDENTIGMMIMKILSNKSKYKLVCWTLSDRGAVGETILHLCMLNATQLHADLAKRLLRFYPNLINDIYIDDEYYGENVLHIAIVNEDPSMVKFLLDSGANVNERCCGNFMCPEDQKASRNDSVEHEWVCVCSETNYDGYVYWGEYPLSFAACLDQEECYRLILAKGADPDSQDTNGNTVLHMLVIYEKLETFDMAYEVGSSLSIRNVLQLTPLTLAAKLARVEMFFHILNIEREIYWQIGSITCAAYPLSQIDTIDVDTGKISNNSALNLVVFGDKEEHLKLLEGVLIDLLNAKWNTFVKSRFYQQFYLFFCYFILSLISCTLRPGPITKTDAPTTTPHPMNDTSLYADVNETSASDPFDLNASDIVILKKGKKELDDWWDDLTEDCRLMQMNSTSAKIRLTAEIFMEFGAILYICAALREARFLGLNMFIENLMTAPSRVMFLFSCCILLSFPFLRMSCADEVEDILAVVVMLTTAPYFLFFCRGFKTVGPFVVMIYRMIMGDLLRFVSIYLVFVMGFSQAYYIIFLSFDNPITPEGVDDSKANPLPSAMESIMAMFLMSMTNFGDYYDAFENTEHEMLAKCLFVVYMAIVSVLLVNMLIAMMGNTYQKIAETRNEWQRQWARIVLVVERGVAPAERLKKLNVYSQPMSDGRKALVLRLNQTDKDKEEMKDILEMKRIHIKSIKRRKDKLQKAKEDAEKLQQQMADKDNKDKAVIIQ

SEQ ID NO: 112 - protein, 1435 aa, Nasonia vitripennis
  MOD_RES (351)..(351): Any amino acid
MGGACSCQGRDSQVNAGSILDRVISQASDEDQCLLYRLANYKKGGELIEAYNQGGQAEVERLIREQFGILMYADGKGQTINRAEYLRWKFRDLDQVILPIEASLSRFDPLAQWSDHEACWQMQYRGSLGETLLHVLIICDTRTHTRIARTLLKCFPRLAIDVVEGEEYLGASALHLAIAYANNELVQDLVEAGAIVSQRAIGSFFLPRDQQRPRPAKSTDYEGLAYLGEYPLAWAACCANESVYNLLLDSGAHPDEQDTFGNSILHMVVVCDKLVRFGYALRHPKLPASNGIANAAGLTPLTLACQLGRAEVFREMLELSAREFWRYSNITCSAYPLNALDTLLPDGRTSXNSALFIILNGTKEEHLDMLDGGIIQRLLEEKWKTFARLQFLKRLVILVFHLVSLSLAVYFRPADTDAELAQWPEEITDVVRVIAECVTVLGVLGYILLQLGGEIVNIGFFSFFKQLSHEPAKFIFLISNLLILACIPCRLSGDRHTEDAILVVAVPGSWFLLMFFAGAVRLTGPFVTMVYSMILGDMRTFGIIYMIVICGFTQAFYFLYKGYPGVKTTLFHSYPSTWMALFQITLGDYSYSDLSMTTYPNLSKAVFTIFMVLVPILLLNMLIAMMGNTYAHVIEQSEKEWMKQWAKIVVSLERAVSQDDAHNYLQEYSIKLGPGDDPNDPASEQRGVMVIKSKSKTRARQRKGAVANWKRVGKVTIAELKKRGMTGEELRRIMWGRASFSTPVRSSPILMEPVSSVPGGFGDALTSALDVMTFAADVPVPIEGSIPKPVAVAPGQQPTTTLALPNGAAKPQQPMMTTSTTTTTITTTVQKTLVTGTATTPAVGVTKTVAVPAATTVSTTTTRASASAVPPTVRPSELGPASAPCSADPLLELMLATEDPGSSEETLQRLAHSARIVGESATTSAKSDIDSSFLERLALGGLGLAAMPEQPDKPVEPKKKQYLALKSSLKSDRASLQHPLSHDGQLGTEARLRRIRSASSRLAPTTTTSTSRRKSGQQKQQREARDDESTSSAASLDNISGYQPLLNEPDTTADQPATGTEDNKPANGRNLRKRPKTTSNEGKVFCSRRTIVVLNKNKKNKKLETSEANMNARKKETLLALHDMTSLISDNWIQINIARFQNNYSHSKVTKNLKKCHLHIESDVLLTSQQCCINISNSKAKMNQALLVVLSFFVVNEDQPVAGWTWGKSATSSSNNSINDDRARYCRICASHTMCLFPYDDPGPKCAAVENGDLEPEEIEWILQRHNSLRDGIARAWKSQYRPLPARDMMQVFWDEELAKIARRWALQCNIHEKDQCRDVEEFSVAQSVSALDLQDAGNRSEMERLKFHLRSWYSQLEPDFSNSAGVGLATPSVTNVGCGRATYSVAIDDSDVAAAVEVLVCNYGPIDDPETEDDSGCETRSRRYSELCQLTRRE

The invention claimed is:

1. A method for determining whether or not a candidate compound is a modulator of an insect transient receptor potential V (TRPV) channel, comprising:
   (a) providing a first cell expressing an insect TRPV channel, wherein the insect TRPV channel co-expresses insect Nanchung and Inactive proteins;
   (b) contacting the first cell with a candidate compound; and
   (c) assaying for a modulation of the insect TRPV channel, wherein the modulation identifies the candidate compound as the modulator of the insect TRPV channel, wherein the assaying step comprises at least one of the following steps:
      (1) detecting calcium ion mobilization in the first cell in response to the candidate compound; or
      (2) detecting a membrane potential in the first cell in response to the candidate compound; or
      (3) comparing calcium ion mobilization in the first cell in the absence of the candidate compound with calcium ion mobilization in the first cell in the presence of the candidate compound; or
      (4) comparing a membrane potential in the first cell in the absence of the candidate compound with a membrane potential in the first cell in the presence of the candidate compound;
      (5) comparing calcium ion mobilization in the first cell in the presence of the candidate compound with calcium ion mobilization reference level indicative of no modulation of the TPRV channel; or
      (6) comparing a membrane potential in the first cell in the presence of the candidate compound with a membrane potential reference level indicative of no modulation of the TPRV channel.

2. The method of claim 1, wherein the candidate compound modulates the calcium ion mobilization or the membrane potential in the first cell by at least 20% relative to the reference level.

3. The method of claim 1, wherein the candidate compound is a modulator that inhibits the activity of the insect TRPV channel.

4. The method of claim 1, wherein the candidate compound is a modulator that activates the insect TRPV channel.

5. The method of claim 4, wherein the insect TRPV channel, when in its source insect, inhibits insect feeding behavior, upon activation.

6. The method of claim 1, wherein the ratio of the Nanchung to Inactive proteins co-expressed in the first cell is about 3:1 to about 1:3.

7. The method of claim 1, wherein the candidate compound is selected from the group consisting of small organic molecule, small inorganic molecule, polysaccharides, peptides, proteins, nucleic acids, an extract made from biological materials, and any combination thereof.

8. The method of claim 1, further comprising:
(a) providing a second cell expressing a mammalian TRPV channel;
(b) contacting the second cell with a candidate compound;
(c) assaying for a modulation of the mammalian TRPV channel;
(d) comparing the modulation of the insect TRPV channel with the modulation of the mammalian TRPV channel, wherein an increased modulation of the insect TRPV channel relative to the mammalian TRPV channel identifies the candidate compound as a selective modulator of the insect TRPV channel.

9. The method of claim 8, wherein an increased modulation of the insect TRPV channel that is at least 10% greater than the modulation of the mammalian TRPV channel identifies the candidate compound as a selective inhibitor.

10. The method of claim 1, wherein the insect TRPV channel is a TRPV channel of an agricultural/horticultural pest or a disease vector or a parasite.

11. The method of claim 10, wherein the agricultural pest is selected from the group consisting of Aphids; Whiteflies; Planthoppers; Leafhoppers; Scales; Mealybugs; Pollen beetles; Thrips; and Psyllids.

12. The method of claim 6, wherein the ratio of the Nanchung to Inactive proteins co-expressed in the first cell is about 1:1.

* * * * *